United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 36

SEQ ID NO: 55782 - protein, 2697 aa, Homo sapiens
MNGDMPHVPITTLAGIASLTDLLNQLPLPSPLPATTTKSLLFNARIAEEVNCLLACRDDNLVSQLVHSLNQVSTDHIELKDNLGSDDPEGDIPVLLQAVLARSPNVFREKSMQNRYVQSGMMMSQYKLSQNSMHSSPASSNYQQTTISHSPSSRFVPPQTSSGNRFMPQQNSPVPSPYAPQSPAGYMPYSHPSSYTTHPQMQQASVSSPIVAGGLRNIHDNKVSGPLSGNSANHHADNPRHGSSEDYLHMVHRLSSDDGDSSTMRNAASFPLRSPQPVCSPAGSEGTPKGSRPPLILQSQSLPCSSPRDVPPDILLDSPERKQKKQKKMKLGKDEKEQSEKAAMYDIISSPSKDSTKLTLRLSRVRSSDMDQQEDMISGVENSNVSENDIPFNVQYPGQTSKTPITPQDINRPLNAAQCLSQQEQTAFLPANQVPVLQQNTSVAAKQPQTSVVQNQQQISQQGPIYDEVELDALAEIERIERESAIERERFSKEVQDKDKPLKKRKQDSYPQEAGGATGGNRPASQETGSTGNGSRPALMVSIDLHQAGRVDSQASITQDSDSIKKPEEIKQCNDAPVSVLQEDIVGSLKSTPENHPETPKKKSDPELSKSEMKQSESRLAESKPNENRLVETKSSENKLETKVETQTEELKQNESRTTECKQNESTIVEPKQNENRLSDTKPNDNKQNNGRSETTKSRPETPKQKGESRPETPKQKSDGHPETPKQKGDGRPETPKQKGESRPETPKQKNEGRPETPKHRHDNRRDSGKPSTEKKPEVSKHKQDTKSDSPRLKSERAEALKQRPDGRSVSESLRRDHDNKQKSDDRGESERHRGDQSRVRRPETLRSSSRNEHGIKSDSSKTDKLERKHRHESGDSRERPSSGEQKSRPDSPRVKQGDSNKSRSDKLGFKSPTSKDDKRTEGNKSKVDTNKAHPDNKAEFPSYLLGGRSGALKNFVIPKIKRDKDGNVTQETKKMEMKGEPKDKVEKIGLVEDLNKGAKPVVVLQKLSLDDVQKLIKDREDKSRSSLKPIKNKPSKSNKGSIDQSVLKELPPELLAEIESTMPLCERVKMNKRKRSTVNEKPKYAEISSDEDNDSDEAFESSRKRHKKDDDKAWEYEERDRRSSGDHRRSGHSHEGRRSSGGGRYRNRSPSDSDMEDYSPPPSLSEVARKMKKKEKQKKRKAYEPKLTPEEMMDSSTFKRFTASIENILDNLEDMDFTAFGDDDEIPQELLLGKHQLNELGSESAKIKAMGIMDKLSTDKTVKVLNILEKNIQDGSKLSTLLNHNNDTEEEERLWRDLIMERVTKSADACLTTINIMTSPNMPKAVYIEDVIERVIQYTKFHLQNTLYPQYDPVYRLDPHGGGLLSSKAKRAKCSTHKQRVIVMLYNKVCDIVSSLSELLEIQLLTDTTILQVSSMGITPFFVENVSELQLCAIKLVTAVFSRYEKHRQLILEEIFTSLARLPTSKRSLRNFRLNSSDMDGEPMYIQMVTALVLQLIQCVVHLPSSEKDSNAEEDSNKKIDQDVVITNSYETAMRTAQNFLSIFLKKCGSKQGEEDYRPLFENFVQDLLSTVNKPEWPAAELLLSLLGRLLVHQFSNKSTEMALRVASLDYLGTVAARLRKDAVTSKMDQGSIERILKQVSGGEDEIQQLQKALLDYLDENTETDPSLVFSRKFYIAQWFRDTTLETEKAMKSQKDEESSEGTHHAKEIETTGQIMHRAENRKKFLRSIIKTTPSQFSTLKMNSDTVDYDDACLIVRYLASMRPFAQSFDIYLTQILRVLGENAIAVRTKAMKCLSEVVAVDPSILARLDMQRGVHGRLMDNSTSVREAAVELLGRFVLCRPQLAEQYYDMLIERILDTGISVRKRVIKILRDICIEQPTFPKITEMCVKMIRRVNDEEGIKKLVNETFQKLWFTPTPHNDKEAMTRKILNITDVVAACRDTGYDWFEQLLQNLLKSEEDSSYKPVKKACTQLVDNLVEHILKYEESLADSDNKGVNSGRLVACITTLFLFSKIRPQLMVKHAMTMQPYLTTKCSTQNDFMVICNVAKILELVVPLMEHPSETFLATIEEDLMKLIIKYGMTVVQHCVSCLGAVVNKVTQNFKFVWACFNRYYGAISKLKSQHQEDPNNTSLLTNKPALLRSLFTVGALCRHFDFDLEDFKGNSKVNIKDKVLELLMYFTKHSDEEVQTKAIIGLGFAFIQHPSLMFEQEVKNLYNNILSDKNSSVNLKIQVLKNLQTYLQEEDTRMQQADRDWKKVAKQEDLKEMGDVSSGMSSSIMQLYLKQVLEAFFHTQSSVRHFALNVIALTLNQGLIHPVQCVPYLIAMGTDPEPAMRNKADQQLVEIDKKYAGFIHMKAVAGMKMSYQVQQAINTCLKDPVRGFRQDESSSALCSHLYSMIRGNRQHRRAFLISLLNLFDDTAKTDVTMLLYIADNLACFPYQTQEEPLFIMHHIDITLSVSGSNLLQSFKESMVKDKRKERKSSPSKENESSDSEEEVSRPRKSRKRVDSDSDSDSEDDINSVMKCLPENSAPLIEFANVSQGILLLLMLKQHLKNLCGFSDSKIQKYSPSESAKVYDKAINRKTGVHFHPKQTLDFLRSDMANSKITEEVKRSIVKQYLDFKLLMEHLDPDEEEEEGEVSASTNARNKAITSLLGGGSPKNNTAAETEDDESDGEDRGGGTSGVRRRRSQRISQRIT

SEQ ID NO: 55783 - protein, 284 aa, Homo sapiens
MAPRLCSISVTARRLLGGPGPRAGDVASAAAARFYSKDNEGSWFRSLFVHKVDPRKDAHSTLLSKKETSNLYKIQFHNVKPEYLDAYNSLTEAVLPKLHLDEDYPCSLVGNWNTWYGEQDQAVHLWRFSGGYPALMDCMNKLKNNKEYLEFRRERSQMLLSRRNQLLLEFSFWNEPQPRMGPNIYELRTYKLKPGTMIEWGNNWARAIKYRQENQEAVGGFFSQIGELYVVHHLWAYKDLQSREETRNAAWRKRGWDENVYYTVPLVRHMESRIMIPLKISPLQ

SEQ ID NO: 55784 - protein, 1434 aa, Homo sapiens
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 55785 - protein, 1468 aa, Homo sapiens
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKYPEPLRFFPRKGPPLPNGDTEVHGLAAARDSQHRSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDEVFSS

SEQ ID NO: 55786 - protein, 407 aa, Homo sapiens
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQMRKLRITEGFGAQRGSHNHPPPQENSPPQRMAAPPSVHASSRSRTGRLRWFSLTPSTLRAHWKRDALSTSAWAPSCILLSMQGGLKTSAQKDSSSLSPKSLLINTIHQLKDLAPKPTWKGWKR

SEQ ID NO: 55787 - protein, 1330 aa, Homo sapiens
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPDMYPDEVHLTVAIVSYRTRDGEGPIHHGVCSSWLNRIQADELVPCFVRGAPSFHLPRNPQVPCILVGPGTGIAPFRSFWQQRQFDIQHKGMNPCPMVLVFGCRQSKIDHIYREETLQAKNKGVFRELYTAYSREPDKPKKYVQDILQEQLAESVYRALKEQGGHIYVCGDVTMAADVLKAIQRIMTQQGKLSAEDAGVFISRMRDDNRYHEDIFGVTLRTYEVTNRLRSESIAFIEESKKDTDDQVFKT

SEQ ID NO: 55788 - protein, 1206 aa, Homo sapiens
MEDHMFGVQQIQPNVISVRLFKRKVGGLGFLVKERVSKPPVIISDLIRGGAAEQSGLIQAGDIILAVNGRPLVDLSYDSALEVLRGIASETHVVLILRGPEGFTTHLETTFTGDGTPKTIRVTQPLGPPTKAVDLSHQPPAGKEQPLAVDGASGPGNGPQHAYDDGQEAGSLPHANGLAPRPPGQDPAKKATRVSLQGRGENNELLKEIEPVLSLLTSGSRGVKGGAPAKAEMKDMGIQVDRDLDGKSHKPLPLGVENDRVFNDLWGKGNVPVVLNNPYSEKEQPPTSGKQSPTKNGSPSKCPRFLKVKNWETEVVLTDTLHLKSTLETGCTEYICMGSIMHPSQHARRPEDVRTKGQLFPLAKEFIDQYYSSIKRFGSKAHMERLEEVNKEIDTTSTYQLKDTELIYGAKHAWRNASRCVGRIQWSKLQVFDARDCTTAHGMFNYICNHVKYATNKGNLRSAITIFPQRTDGKHDFRVWNSQLIRYAGYKQPDGSTLGDPANVQFTEICIQQGWKPPRGRFDVLPLLLQANGNDPELFQIPPELVLEVPIRHPKFEWFKDLGLKWYGLPAVSNMLLEIGGLEFSACPFSGWYMGTEIGVRDYCDNSRYNILEEVAKKMNLDMRKTSSLWKDQALVEINIAVLYSFQSDKVTIVDHHSATESFIKHMENEYRCRGGCPADWVWIVPPMSGSITPVFHQEMLNYRLTPSFEYQPDPWNTHVWKGTNGTPTKRRAIGFKKLAEAVKFSAKLMGQAMAKRVKATILYATETGKSQAYAKTLCEIFKHAFDAKVMSMEEYDIVHLEHETLVLVVTSTFGNGDPPENGEKFGCALMEMRHPNSVQEERKSYKVRFNSVSSYSDSQKSSGDGPDLRDNFESAGPLANVRFSVFGLGSRAYPHFCAFGHAVDTLLEELGGERILKMREGDELCGQEEAFRTWAKKVFKAACDVFCVGDDVNIEKANNSLISNDRSWKRNKFRLTFVAEAPELTQGLSNVHKKRVSAARLLSRQNLQSPKSSRSTIFVRLHTNGSQELQYQPGDHLGVFPGNHEDLVNALIERLEDAPPVNQMVKVELLEERNTALGVISNWTDELRLPPCTIFQAFKYYLDITTPPTPLQLQQFASLATSEKEKQRLLVLSKGLQEYEEWKWGKNPTIVEVLEEFPSIQMPATLLLTQLSLLQPRYYSISSSPHTHTLSETRPSPLPLSSQCC

SEQ ID NO: 55789 - protein, 67 aa, Homo sapiens
HPNSVQEERKYPEPLRFFPRKGPPLPNGDTEVHGLAAARDSQHRSYKVRFNSVSSYSDSQKSSGDGP

SEQ ID NO: 55790 - protein, 506 aa, Homo sapiens
MPSKTKYNLVDDGHDLRIPLHNEDAFQHGICFEAKYVGSLDVPRPNSRVEIVAAMRRIRYEFKAKNIKKKKVSIMVSVDGVKVILKKKKKLLLLQKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 55791 - protein, 211 aa, Homo sapiens
MSLSSLCPVFSAAASSLQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 55792 - protein, 501 aa, Homo sapiens
MPSKTKYNLVDDGHDLRIPLHNEDAFQHGICFEAKYVGSLDVPRPNSRVEIVAAMRRIRYEFKAKNIKKKKVSIMVSVDGVKVILKKKKKKKEWTWDESKMLVMQDPIYRIFYVSHDSQDLKIFSYIARDGASNIFRCNVFKSKKKSQAMRIVRTVGQAFEVCHKLSLQHTQQNADGQEDGESERNSNSSGDPGRQLTGAERASTATAEETDIDAVEVPLPGNDVLEFSRGVTDLDAVGKEGGSHTGSKVSHPQEPMLTASPRMLLPSSSSKPPGLGTETPLSTHHQMQLLQQLLQQQQQQTQVAVAQVHLLKDQLAAEAAARLEAQARVHQLLLQNKDMLQHISLLVKQVQELELKLSGQNAMGSQDSLLEITFRSGALPVLCDPTTPKPEDLHSPPLGAGLADFAHPAGSPLGRRDCLVKLECFRFLPPEDTPPPAQGEALLGGLELIKFRESGIASEYESNTDESEERDSWSQEELPRLLNVLQRQELGDGLDDEIAV

SEQ ID NO: 55793 - protein, 729 aa, Homo sapiens
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLIRYAGYQMPDGSIRGDPANVEFTQLCIDLGWKPKYGRFDVVPLVLQANGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLPAASTSPRIPPILASSSGLAQASRPSAVSGSNGSMTPSTRECGEAA

SEQ ID NO: 55794 - protein, 1153 aa, Homo sapiens
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLIRYAGYQMPDGSIRGDPANVEFTQLCIDLGWKPKYGRFDVVPLVLQANGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 55795 - protein, 1114 aa, Homo sapiens
MACPWKFLFKTKFHQYAMNGEKDINNNVEKAPCATSSPVTQDDLQYHNLSKQQNESPQPLVETGKKSPESLVKLDATPLSSPRHVRIKNWGSGMTFQDTLHHKAKGILTCRSKSCLGSIMTPKSLTRGPRDKPTPPDELLPQAIEFVNQYYGSFKEAKIEEHLARVEAVTKEIETTGTYQLTGDELIFATKQAWRNAPRCIGRIQWSNLQVFDARSCSTAREMFEHICRHVRYSTNNGNIRSAITVFPQRSDGKHDFRVWNAQLCIDLGWKPNGRDPELFEIPPDLVLEVAMEHPKYEWFRELELKWYALPAVANMLLEVGGLEFPGCPFNGWYMGTEIGVRDFCDVQRYNILEEVGRRMGLETHKLASLWKDQAVVEINIAVLHSFQKQNVTIMDHHSAAESFMKYMQNEYRSRGGCPADWIWLVPPMSGSITPVFHQEMLNYVLSPFYYYQVEAWKTHVWQDEKRRPKRREIPLKVLVKAVLFACMLMRKTMASRVRVTILFATETGKSEALAWDLGALFSCAFNPKVVCMDKYRLSCLEEERLLLVVTSTFGNGDCPGNGEKLKKSLFMLKELNNKFRYAVFGLGSSMYPRFCAFAHDIDQKLSHLGASQLTPMGEGDELSGQEDAFRSWAVQTFKAACETFDVRGKQHIQIPKLYTSNVTWDPHHYRLVQDSQPLDLSKALSSMHAKNVFTMRLKSRQNLQSPTSSRATILVELSCEDGQGLNYLPGEHLGVCPGNQPALVQGILERVVDGPTPHQTVRLEALDESGSYWVSDKRLPPCSLSQALTYFLDITTPPTQLLLQKLAQVATEEPERQRLEALCQPSEYSKWKFTNSPTFLEVLEEFPSLRVSAGFLLSQLPILKPRFYSISSSRDHTPTEIHLTVAVVTYHTRDGQGPLHHGVCSTWLNSLKPQDPVPCFVRNASGFHLPEDPSHPCILIGPGTGIAPFRSFWQQRLHDSQHKGVRGGRMTLVFGCRRPDEDHIYQEEMLEMAQKGVLHAVHTAYSRLPGKPKVYVQDILRQQLASEVLRVLHKEPGHLYVCGDVRMARDVAHTLKQLVAAKLKLNEEQVEDYFFQLKSQKRYHEDIFGAVFPYEAKKDRVAVQPSSLEMSAL

SEQ ID NO: 55796 - protein, 1203 aa, Homo sapiens
MGNLKSVAQEPGPPCGLGLGLGLGLCGKQGPATPAPEPSRAPASLLPPAPEHSPPSSPLTQPPEGPKFPRVKNWEVGSITYDTLSAQAQQDGPCTPRRCLGSLVFPRKLQGRPSPGPPAPEQLLSQARDFINQYYSSIKRSGSQAHEQRLQEVEAEVAATGTYQLRESELVFGAKQAWRNAPRCVGRIQWGKLQVFDARDCRSAQEMFTYICNHIKYATNRGNLRSAITVFPQRCPGRGDFRIWNSQLVRYAGYRQQDGSVRGDPANVEITELCIQHGWTPGNGRFDVLPLLLQAPDDPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESFAAALMEMSGPYNSSPRPEQHKSYKIRFNSISCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGAPSFRLPPDPSLPCILVGPGTGIAPFRGFWQERLHDIESKGLQPTPMTLVFGCRCSQLDHLYRDEVQNAQQRGVFGRVLTAFSREPDNPKTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 55797 - protein, 997 aa, Homo sapiens
MFTYICNHIKYATNRGNLRSAITVFPQRCPGRGDFRIWNSQLVRYAGYRQQDGSVRGDPANVEITELCIQHGWTPGNGRFDVLPLLLQAPDDPPELFLLPPELVLEVPLEHPTLEWFAALGLRWYALPAVSNMLLEIGGLEFPAAPFSGWYMSTEIGTRNLCDPHRYNILEDVAVCMDLDTRTTSSLWKDKAAVEINVAVLHSYQLAKVTIVDHHAATASFMKHLENEQKARGGCPADWAWIVPPISGSLTPVFHQEMVNYFLSPAFRYQPDPWKGSAAKGTGITRKKTFKEVANAVKISASLMGTVMAKRVKATILYGSETGRAQSYAQQLGRLFRKAFDPRVLCMDEYDVVSLEHETLVLVVTSTFGNGDPPENGESFAAALMEMSGPYNSSPRPEQHKSYKIRFNSISCSDPLVSSWRRKRKESSNTDSAGALGTLRFCVFGLGSRAYPHFCAFARAVDTRLEELGGERLLQLGQGDELCGQEEAFRGWAQAAFQAACETFCVGEDAKAAARDIFSPKRSWKRQRYRLSAQAEGLQLLPGLIHVHRRKMFQATIRSVENLQSSKSTRATILVRLDTGGQEGLQYQPGDHIGVCPPNRPGLVEALLSRVEDPPAPTEPVAVEQLEKGSPGGPPPGWVRDPRLPPCTLRQALTFFLDITSPPSPQLLRLLSTLAEEPREQQELEALSQDPRRYEEWKWFRCPTLLEVLEQFPSVALPAPLLLTQLPLLQPRYYSVSSAPSTHPGEIHLTVAVLAYRTQDGLGPLHYGVCSTWLSQLKPGDPVPCFIRGAPSFRLPPDPSLPCILVGPGTGIAPFRGFWQERLHDIESKGLQPTPMTLVFGCRCSQLDHLYRDEVQNAQQRGVFGRVLTAFSREPDNPKTYVQDILRTELAAEVHRVLCLERGHMFVCGDVTMATNVLQTVQRILATEGDMELDEAGDVIGVLRDQQRYHEDIFGLTLRTQEVTSRIRTQSFSLQERQLRGAVPWAFDPPGSDTNSP

SEQ ID NO: 55798 - protein, 506 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 55799 - protein, 428 aa, Homo sapiens
MKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 55800 - protein, 563 aa, Homo sapiens
MRDPLTDCPYNKVYKNLKEFSQNGENFCKQVTSVLQQRANLEISYAKGLQKLASKLSKALQNTRKSCVSSAWAWASEGMKSTADLHQKLGKAIELEAIKPTYQVLNVQEKKRKSLDNEVEKTANLVISNWNQQIKAKKKLMVSTKKHEALFQLVESSKQSMTEKEKRKLLNKLTKSTEKLEKEDENYYQKNMAGYSTRLKWENTLENCYQVTHSICLYAFWVKRAWGKCVSDLRYQDTFLPGNLPPLWFGYDIVKRLIMRLCSVCLQSILELEKERIQLLCNNLNQYSQHISLFGQTLTTCHTQIHCAISKIDIEKDIQAVMEETAILSTENKSEFLLTDYFEEDPNSAMDKERRKSLLKPKLLRLQRDIEKASKDKEGLERMLKTYSSTSSFSDAKSQKDTAALMDENNLKLDLLEANSYKLSSMLAELEQRPQPSHPCSNSIFRWREKEHTHSYVKISRPFLMKRLENIVSKASSGGQSNPGSSTPAPGAAQLSSRLCKALYSFQARQDDELNLEKGDIVIIHEKKEGGWWFGSLNGKKGHFPAAYVEELPSNAGNTATKA

SEQ ID NO: 55801 - protein, 563 aa, Homo sapiens; identical to SEQ ID NO: 55800

SEQ ID NO: 55802 - protein, 312 aa, Homo sapiens
MTFGLRKRLSEERGFSLMPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 55803 - protein, 243 aa, Homo sapiens
MLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEPVSS

SEQ ID NO: 55804 - protein, 327 aa, Homo sapiens
MLGFITRPPHRFLSLLCPGLRIPQLSVLCAQPRPRAMAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 55805 - protein, 291 aa, Homo sapiens
MAISSSSCELPLVAVCQVTSTPDKQQNFKTCAELVREAARLGACLAFLPEAFDFIARDPAETLHLSEPLGGKLLEEYTQLARECGLWLSLGGFHERGQDWEQTQKIYNCHVLLNSKGAVVATYRKTHLCDVEIPGQGPMCESNSTMPGPSLESPVSTPAGKIGLAVCYDMRFPELSLALAQAGAEILTYPSAFGSITGPAHWEVLLRARAIETQCYVVAAAQCGRHHEKRASYGHSMVVDPWGTVVARCSEGPGLCLARIDLNYLRQLRRHLPVFQHRRPDLYGNLGHPLS

SEQ ID NO: 55806 - protein, 273 aa, Homo sapiens
MSLTNTKTGFSVKDILDLPDTNDEEGSVAEGPEEENEGPEPAKRAGPLGQGALDAVQSLPLKNPFYDSSDNPYTRWLASTEGLQYSLHGLAAGAPPQDSSSKSPEPSADESPDNDKETPGGGGDAGKKRKRRVLFSKAQTYELERRFRQQRYLSAPEREHLASLIRLTPTQVKIWFQNHRYKMKRARAEKGMEVTPLPSPRRVAVPVLVRDGKPCHALKAQDLAAATFQAGIPFSAYSAQSLQHMQYNAQYSSASTPQYPTAHPLVQAQQWTW

SEQ ID NO: 55807 - protein, 354 aa, Homo sapiens
MSLSPKHTTPFSVSDILSPIEETYKKFSGAMDGAPPGLGAPLGAAAAYRAPPPGPSSQAATVAGMQPSHAMAGHNAAAAAAAAAAAAAAAATYHMPPGVSQFPHGAMGSYCNGGLGNMGELPAYTDGMRGGAATGWYGANPDPRYSSISRFMGPSAGVNVAGMGSLTGIADAAKSLGPLHAAAAAAAPRRKRRVLFSQAQVYELERRFKQQKYLSAPEREHLASMIHLTPTQVKIWFQNHRYKMKRQAKDKAAQQLQQEGGLGPPPPPPPSPRRVAVPVLVKDGKPCQNGASTPTPGQAGPQPPAPTPAPELEELSPSPPALHGPGGGLAALDAAAGEYSGGVLGANLLYGRTW

SEQ ID NO: 55808 - protein, 324 aa, Homo sapiens
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKELCALQKAVELEKTEADNAERPRARRRRKPRVLFSQAQVYELERRFKQQRYLSAPERDQLASVLKLTSTQVKIWFQNRRYKCKRQRQDQTLELVGLPPPPPPPARRIAVPVLVRDGKPCLGDSAPYAPAYGVGLNPYGYNAYPAYPGYGGAACSPGYSCTAAYPAGPSPAQPATAAANNNFVNFGVGDLNAVQSPGIPQSNSGVSTLHGIRAW

SEQ ID NO: 55809 - protein, 112 aa, Homo sapiens
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKA

SEQ ID NO: 55810 - protein, 151 aa, Homo sapiens
MFPSPALTPTPFSVKDILNLEQQQRSLAAAGELSARLEATLAPSSCMLAAFKPEAYAGPEAAAPGLPELRAELGRAPSPAKCASAFPAAPAFYPRAYSDPDPAKDPRAEKKGCELPRGQRPPVLFSSALSQPDFLQMLSETCRWLPVHLAE

SEQ ID NO: 55811 - protein, 301 aa, Homo sapiens
MLLSPVTSTPFSVKDILRLERERSCPAASPHPRVRKSPENFQYLRMDAEPRGSEVHNAGGGGGDRKLDGSEPPGGPCEAVLEMDAERMGEPQPGLNAASPLGGGTRVPERGVGNSGDSVRGGRSEQPKARQRRKPRVLFSQAQVLALERRFKQQRYLSAPEREHLASALQLTSTQVKIWFQNRRYKCKRQRQDKSLELAGHPLTPRRVAVPVLVRDGKPCLGPGPGAPAFPSPYSAAVSPYSCYGGYSGAPYGAGYGTCYAGAPSGPAPHTPLASAGFGHGGQNATPQGHLAATLQGVRAW

SEQ ID NO: 55812 - protein, 219 aa, Homo sapiens
MDAERMGEPQPGLNAASPLGGGTRVPERGVGNSGDSVRGGRSEQPKARQRRKPRVLFSQAQVLALERRFKQQRYLSAPEREHLASALQLTSTQVKIWFQNRRYKCKRQRQDKSLELAGHPLTPRRVAVPVLVRDGKPCLGPGPGAPAFPSPYSAAVSPYSCYGGYSGAPYGAGYGTCYAGAPSGPAPHTPLASAGFGHGGQNATPQGHLAATLQGVRAW

SEQ ID NO: 55813 - protein, 239 aa, Homo sapiens
MATSGRLSFTVRSLLDLPEQDAQHLPRREPEPRAPQPDPCAAWLDSERGHYPSSDESSLETSPPDSSQRPSARPASPGSDAEKRKKRRVLFSKAQTLELERRFRQQRYLSAPEREQLASLLRLTPTQVKIWFQNHRYKLKRARAPGAAESPDLAASAELHAAPGLLRRVVVPVLVRDGQPCGGGGGGEVGTAAAQEKCGAPPAAACPLPGYPAFGPGSALGLFPAYQHLASPALVSWNW

SEQ ID NO: 55814 - protein, 333 aa, Homo sapiens
MAVRGANTLTSFSIQAILNKKEERGGLAAPEGRPAPGGTAASVAAAPAVCCWRLFGERDAGALGGAEDSLLASPAGTRTAAGRTAESPEGWDSDSALSEENESRRRCADARGASGAGLAGGSLSLGQPVCELAASKDLEEEAAGRSDSEMSASVSGDRSPRTEDDGVGPRGAHVSALCSGAGGGGGSGPAGVAEEEEEPAAPKPRKKRSRAAFSHAQVFELERRFNHQRYLSGPERADLAASLKLTETQVKIWFQNRRYKTKRRQMAADLLASAPAAKKVAVKVLVRDDQRQYLPGEVLRPPSLLPLQPSYYYPYYCLPGWALSTCAAAAGTQ

SEQ ID NO: 55815 - protein, 265 aa, Homo sapiens
MESNLQGTFLLNNTPLAQFPEMKAPVCQYSVQNSFYKLSPPGLGPQLAAGTPHGITDILSRPVAAPNNSLLSGYPHVAGFGGLSSQGVYYSPQVGNFSKAGNEYPTRTRNCWADTGQDWRGGRQCSNTPDPLSDSIHKKKHTRPTFTGHQIFALEKTFEQTKYLAGPERARLAYSLGMTESQVKVWFQNRRTKWRKKSALEPSSSTPRAPGGAGAGAGGDRAPSENEDDEYNKPLDPDSDDEKIRLLLRKHRAAFSVLSLGAHSV

SEQ ID NO: 55816 - protein, 135 aa, Homo sapiens
MQQGQLAPGSRLCSGPWGLPELQPAAPSSSAAQLPWGESWGEEADTPACLSASGVWFQNRRTKWRKKSALEPSSSTPRAPGGAGAGAGGDRAPSENEDDEYNKPLDPDSDDEKIRLLLRKHRAAFSVLSLGAHSV

SEQ ID NO: 55817 - protein, 975 aa, Homo sapiens
MRWGHHLPRASWGSGFRRALQRPDDRIPFLIHWSWPLQGERPFGPPRAFIRHHGSSVDSAPPPGRHGRLFPSASATEAIQRHRRNLAEWFSRLPREERQFGPTFALDTVHVDPVIRESTPDELLRPPAELALEHQPPQAGLPPLALSQLFNPDACGRRVQTVVLYGTVGTGKSTLVRKMVLDWCYGRLPAFELLIPFSCEDLSSLGPAPASLCQLVAQRYTPLKEVLPLMAAAGSHLLFVLHGLEHLNLDFRLAGTGLCSDPEEPQEPAAIIVNLLRKYMLPQASILVTTRPSAIGRIPSKYVGRYGEICGFSDTNLQKLYFQLRLNQPYCGYAVGGSGVSATPAQRDHLVQMLSRNLEGHHQIAAACFLPSYCWLVCATLHFLHAPTPAGQTLTSIYTSFLRLNFSGETLDSTDPSNLSLMAYAARTMGKLAYEGVSSRKTYFSEEDVCGCLEAGIRTEEEFQLLHIFRRDALRFFLAPCVEPGRAGTFVFTVPAMQEYLAALYIVLGLRKTTLQKVGKEVAELVGRVGEDVSLVLGIMAKLLPLRALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTAAGVAVLMEGLAGNTSVTHLSLLHTGLGDEGLELLAAQLDRNRQLQELNVAYNGAGDTAALALARAAREHPSLELLHLYFNELSSEGRQVLRDLGGAAEGGARVVVSLTEGTAVSEYWSVILSEVQRNLNSWDRARVQRHLELLLRDLEDSRGATLNPWRKAQLLRVEGEVRALLEQLGSSGS

SEQ ID NO: 55818 - protein, 114 aa, Homo sapiens
GISKLKMVNQCFGLGDGTCLLSIQLEGPKHVAFGWPECPEAPLPTLPPPPLKEPLTVSPRGSHLMSAMPGVSPSRCVGSFPSCLMLTCGHRGCPHIGAFSSSSCPLCHNGMMAW

SEQ ID NO: 55819 - protein, 975 aa, Homo sapiens; identical to SEQ ID NO: 55817

SEQ ID NO: 55820 - protein, 921 aa, Homo sapiens
MRWGHHLPRASWGSGFRRALQRPDDRIPFLIHWSWPLQGERPFGPPRAFIRHHGSSVDSAPPPGRHGRLFPSASATEAIQRHRRNLAEWFSRLPREERQFGPTFALDTVHVDPVIRESTPDELLRPPAELALEHQPPQAGLPPLALSQLFNPDACGRRVQTVVLYGTVGTGKSTLVRKMVLDWCYGRLPAFELLIPFSCEDLSSLGPAPASLCQLVAQRYTPLKEVLPLMAAAGSHLLFVLHGLEHLNLDFRLAGTGLCSDPEEPQEPAAIIVNLLRKYMLPQASILVTTRPSAIGRIPSKYVGRYGEICGFSDTNLQKLYFQLRLNQPYCGYAVGGSGVSATPAQRDHLVQMLSRNLEGHHQIAAACFLPSYCWLVCATLHFLHAPTPAGQTLTSIYTSFLRLNFSGETLDSTDPSNLSLMAYAARTMGKLAYEGVSSRKTYFSEEDVCGCLEAGIRTEEEFQLLHIFRRDALRFFLAPCVEPGRAGTFVFTVPAMQEYLAALYIVLGLRKTTLQKVGKEVAELVGRVGEDVSLVLGIMAKLLPLRALPLLFNLIKVVPRVFGRMVGKSREAVAQAMVLEMFREEDYYNDDVLDQMGASILGVEGPRRHPDEPPEDEVFELFPMFMGGLLSAHNRAVLAQLGCPIKNLDALENAQAIKKKLGKLGRQVLPPSELLDHLFFHYEFQNQRFSAEVLSSLRQLNLAGVRMTPVKCTVVAAVLGSGRHALDEVNLASCQLDPAGLRTLLPVFLRARKLGLQLNSLGPEACKDLRDLLLHDQCQITTLRLSNNPLTAAGVAVLMEGLAGNTSVTHLSLLHTGLGDEGLELLAAQLDRNRQLQELNVAYNGAGDTAALALARAAREHPSLELLQGVAIQMCWKLPLLPYAHLWTPRMPSHWCFLLILMPPLPQWYDGLVAPRGRCT

SEQ ID NO: 55821 - protein, 975 aa, Homo sapiens; identical to SEQ ID NO: 55817

SEQ ID NO: 55822 - protein, 921 aa, Homo sapiens; identical to SEQ ID NO: 55820

SEQ ID NO: 55823 - protein, 1036 aa, Homo sapiens
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 55824 - protein, 922 aa, Homo sapiens
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLGRCGLSHECCFDISLVLSSNQKLVELDLSDNALGDFGIRLLCVGLKHLLCNLKKLWLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 55825 - protein, 979 aa, Homo sapiens
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLVNSHLTSSFCRGLFSVLSTSQSLTELDLSDNSLGDPGMRVLCETLQHPGCNIRRLWLGRCGLSHECCFDISLVLSSNQKLVELDLSDNALGDFGIRLLCVGLKHLLCNLKKLWLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 55826 - protein, 979 aa, Homo sapiens; identical to SEQ ID NO: 55825

SEQ ID NO: 55827 - protein, 979 aa, Homo sapiens
MKMASTRCKLARYLEDLEDVDLKKFKMHLEDYPPQKGCIPLPRGQTEKADHVDLATLMIDFNGEEKAWAMAVWIFAAINRRDLYEKAKRDEPKWGSDNARVSNPTVICQEDSIEEEWMGLLEYLSRISICKMKKDYRKKYRKYVRSRFQCIEDRNARLGESVSLNKRYTRLRLIKEHRSQQEREQELLAIGKTKTCESPVSPIKMELLFDPDDEHSEPVHTVVFQGAAGIGKTILARKMMLDWASGTLYQDRFDYLFYIHCREVSLVTQRSLGDLIMSCCPDPNPPIHKIVRKPSRILFLMDGFDELQGAFDEHIGPLCTDWQKAERGDILLSSLIRKKLLPEASLLITTRPVALEKLQHLLDHPRHVEILGFSEAKRKEYFFKYFSDEAQARAAFSLIQENEVLFTMCFIPLVCWIVCTGLKQQMESGKSLAQTSKTTTAVYVFFLSSLLQPRGGSQEHGLCAHLWGLCSLAADGIWNQKILFEESDLRNHGLQKADVSAFLRMNLFQKEVDCEKFYSFIHMTFQEFFAAMYYLLEEEKEGRTNVPGSRLKLPSRDVTVLLENYGKFEKGYLIFVVRFLFGLVNQERTSYLEKKLSCKISQQIRLELLKWIEVKAKAKKLQIQPSQLELFYCLYEMQEEDFVQRAMDYFPKIEINLSTRMDHMVSSFCIENCHRVESLSLGFLHNMPKEEEEEEKEGRHLDMVQCVLPSSSHAACSHGLGRCGLSHECCFDISLVLSSNQKLVELDLSDNALGDFGIRLLCVGLKHLLCNLKKLWLVSCCLTSACCQDLASVLSTSHSLTRLYVGENALGDSGVAILCEKAKNPQCNLQKLGLVNSGLTSVCCSALSSVLSTNQNLTHLYLRGNTLGDKGIKLLCEGLLHPDCKLQVLELDNCNLTSHCCWDLSTLLTSSQSLRKLSLGNNDLGDLGVMMFCEVLKQQSCLLQNLGLSEMYFNYETKSALETLQEEKPELTVVFEPSW

SEQ ID NO: 55828 - protein, 1036 aa, Homo sapiens; identical to SEQ ID NO: 55823

SEQ ID NO: 55829 - protein, 503 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPCRYKASQRLISQDIHSNTYNYKSTFSVEIVPICKDNVVCLSPKLAQSLGNMNQICVCIRVTSAIHLIDPNTLQVADIDGSTFWSHPFNSLCHPKQLEEFIVMECSIVQDIKRAAGAGMISKKHTLGEVWVQKTSEMNTDKQYFCRTHLGHLLNPGDLVLGFDLANCNLNDEHVNKMNSDRVPDVVLIKKSYDRTKRQRRRNWKLKELARERENMDTDDERQYQDFLEDLEEDEAIRKNVNIYRDSAIPVESDTDDEGAPRISLAEMLEDLHISQDATGEEGASMLT

SEQ ID NO: 55830 - protein, 503 aa, Homo sapiens; identical to SEQ ID NO: 55829

SEQ ID NO: 55831 - protein, 156 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAV

SEQ ID NO: 55832 - protein, 218 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQKTLHKKTFYYLEQLILKYGMHQNTLRIKEIHDGLDFYYSSKQHAQKMVEFLQCTVPC

SEQ ID NO: 55833 - protein, 98 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDA

SEQ ID NO: 55834 - protein, 162 aa, Homo sapiens
MEYMAESTDRSPGHILCCECGVPISPNPANICVACLRSKVDISQGIPKQVSISFCKQCQRYFQPPGTWIQCALESRELLALCLKKIKAPLSKVRLVDAGFVWTEPHSKRLKVKLTIQKEVMNGAILQQVFVVDYVVQSQMCGDCHRVEAKDFWKAVIQVRQK

SEQ ID NO: 55835 - protein, 218 aa, Homo sapiens; identical to SEQ ID NO: 55832

SEQ ID NO: 55836 - protein, 383 aa, Homo sapiens [sequence omitted]

SEQ ID NO: 55837 - protein, 982 aa, Homo sapiens
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKDPNAEKLVSRYHPQIALTSQSLFTLLNNHGPTYKEQWEIPVCIQVIPVAGSKPVKVIYINSPLPQKKMTMRERNQIFHEVPLKFMMSKNTSVPVSAVFMDKPEEFISEMDMSCEVNECRKIESLENLYLDFDDDVTELETFGVTTTKVSKSPSPASTSTVPNMTDAPTAPKAGTTTVAPSAPDISANSRSLSQILMEQLQKEKQLVTGMDGGPEECKNKDDQGFESCEKVSNSDKPLIQDSDLKTSDALQLENSQEIETSNKNDMTIDILHADGERPNVLENLDNSKEKTVGSEAAKTEDTVLCSSDTDEECLIIDTECKNNSDGKTAVVGSNLSSRPASPNSSSGQASVGNQTNTACSPEESCVLKKPIKRVYKKFDPVGEILKMQDELLKPISRKVPELPLMNLENSKQPSVSEQLSGPSDSSSWPKSGWPSAFQKPKGRLPYELQDYVEDTSEYLAPQEGNFVYKLFSLQDLLLLVRCSVQRIETRPRSKKRKKIRRQFPVYVLPKVEYQACYGVEALTESELCRLWTESLLHSNSSFYVGHIDAFTSKLFLLEEITSEELKEKLSALKISNLFNILQHILKKLSSLQEGSYLLSHAAEDSSLLIYKASDGKVTRTAYNLYKTHCGLPGVPSSLSVPWVPLDPSLLLPYHIHHGRIPCTFPPKSLDTTTQQKIGGTRMPTRSHRNPVSMETKSSCLPAQQVETEGVAPHKRKIT

SEQ ID NO: 55838 - protein, 845 aa, Homo sapiens
MKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKDPNAEKLVSRYHPQIALTSQSLFTLLNNHGPTYKEQWEIPVCIQVIPVAGSKPVKVIYINSPLPQKKMTMRERNQIFHEVPLKFMMSKNTSVPVSAVFMDKPEEFISEMDMSCEVNECRKIESLENLYLDFDDDVTELETFGVTTTKVSKSPSPASTSTVPNMTDAPTAPKAGTTTVAPSAPDISANSRSLSQILMEQLQKEKQLVTGMDGGPEECKNKDDQGFESCEKVSNSDKPLIQDSDLKTSDALQLENSQEIETSNKNDMTIDILHADGERPNVLENLDNSKEKTVGSEAAKTEDTVLCSSDTDEECLIIDTECKNNSDGKTAVVGSNLSSRPASPNSSSGQASVGNQTNTACSPEESCVLKKPIKRVYKKFDPVGEILKMQDELLKPISRKVPELPLMNLENSKQPSVSEQLSGPSDSSSWPKSGWPSAFQKPKGRLPYELQDYVEDTSEYLAPQEGNFVYKLFSLQDLLLLVRCSVQRIETRPRSKKRKKIRRQFPVYVLPKVEYQACYGVEALTESELCRLWTESLLHSNSSFYVGHIDAFTSKLFLLEEITSEELKEKLSALKISNLFNILQHILKKLSSLQEGSYLLSHAAEDSSLLIYKASDGKVTRTAYNLYKTHCGLPGVPSSLSVPWVPLDPSLLLPYHIHHGRIPCTFPPKSLDTTTQQKIGGTRMPTRSHRNPVSMETKSSCLPAQQVETEGVAPHKRKIT

SEQ ID NO: 55839 - protein, 338 aa, Homo sapiens
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEEVTEFLKFLQNSAKKCAQDYNMLSDDARLFTEKILRACIEQVKKYSEFYTLHEVTSLMGFFPFRVEMGLKLEKTLLALGSVKYVKTVFPSMPIKLQLSKDDIATIETSEQTAEAMHYDISKDPNAEKLVSRYHPQIALTSQSLFTLLNNHGPTYKEQWEIPVCIQVIPVAGSKPVKVIYINSPLPQKKMTMRER

SEQ ID NO: 55840 - protein, 145 aa, Homo sapiens
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSRFSQREQRSYVDLLVKYAKIPANSKAVGINKNDYLQYLDMKKHVNEE

SEQ ID NO: 55841 - protein, 99 aa, Homo sapiens
MSSKMVISEPGLNWDISPKNGLKTFFSRENYKDHSMAPSLKELRVLSNRRIGENLNASASSVENEPAVSSATQAKEKVKTTIGMVLLPKPRVPYPRFSR

SEQ ID NO: 55842 - protein, 94 aa, Homo sapiens
MSSKMVISEPGLNWDISPKNGLKTFFSRENYKDHSMAPSLKELRVLSNRRIGENLNASASSVENEPAVSSATQAKEKVKTTIGMVLLPKPRVPY

SEQ ID NO: 55843 - protein, 281 aa, Homo sapiens
MGQKKQRPARAGQPHSSSDAAQAPAEQPHSSSDAAQAPCPRERCLGPPTTPGPYRSIYFSSPKGHLTRLGLEFFDQPAVPLARAFLGQVLVRRLPNGTELRGRIVETEAYLGPEDEAAHSRGGRQTPRNRGMFMKPGTLYVYIIYGMYFCMNISSQGDGACVLLRALEPLEGLETMRQLRSTLRKGTASRVLKDRELCSGPSKLCQALAINKSFDQRDLAQDEAVWLERGPLEPSEPAVVAAARVGVGHAGEWARKPLRFYVRGSPWVSVVDRVAEQDTQA

SEQ ID NO: 55844 - protein, 307 aa, Homo sapiens
MEADKDDTQQILKEHSPDEFIKDEQNKGLIDEITKKNIQLKKEIQKLETELQEATKEFQIKEDIPETKMKFLSVETPENDSQLSNISCSFQVSSKVPYEIQKGQALITFEKEEVAQNVVSMSKHHVQIKDVNLEVTAKPVPLNSGVRFQVYVEVSKMKINVTEIPDTLREDQMRDKLELSFSKSRNGGGEVDRVDYDRQSGSAVITFVEIGVADKILKKKEYPLYINQTCHRVTVSPYTEIHLKKYQIFSGTSKRTVLLTGMEGIQMDEEIVEDLINIHFQRAKNGGGEVDVVKCSLGQPHIAYFEE

SEQ ID NO: 55845 - protein, 29 aa, Homo sapiens
MEADKDDTQQILKEHSPDEFIKDEQNKGL

SEQ ID NO: 55846 - protein, 394 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 55847 - protein, 324 aa, Homo sapiens
MSREMQDVDLAEVKPLVEKGETITGLLQEFDVQEQDIETLHGSVHVTLCGTPKGNRPVILTYHDIGMNHKTCAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 55848 - protein, 394 aa, Homo sapiens; identical to SEQ ID NO: 55846

SEQ ID NO: 55849 - protein, 165 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVEGLVLINV

SEQ ID NO: 55850 - protein, 158 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKSIIGMGTGAGAYILTRFALNNPEMVE

SEQ ID NO: 55851 - protein, 133 aa, Homo sapiens
MSREMQDVDLAEVKPLVEKGETITGLLQEFDVQEQDIETLHGSVHVTLCGTPKGNRPVILTYHDIGMNHKTCYNPLFNYEDMQEITQHFAVCHVDAPGQQDGAASFPAGYMYPSMDQLAEMLPGVLQQFGLKS

SEQ ID NO: 55852 - protein, 158 aa, Homo sapiens; identical to SEQ ID NO: 55850

SEQ ID NO: 55853 - protein, 222 aa, Homo sapiens
MDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 55854 - protein, 149 aa, Homo sapiens
MSREMQDVDLAEVKPLVEKGETITGLLQEFDVQEQDIETLHGSVHVTLCGTPPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 55855 - protein, 313 aa, Homo sapiens
MQEITQHFAVCHVDAPGQQDGAASFPAGYMYPSMDQLAEMLPGVLQQFGLKSIIGMGTGAGAYILTRFALNNPEMVEGLVLINVNPCAEGWMDWAASKISGWTQALPDMVVSHLFGKEEMQSNVEVVHTYRQHIVNDMNPGNLHLFINAYNSRRDLEIERPMPGTHTVTLQCPALLVVGDSSPAVDAVVECNSKLDPTKTTLLKMADCGGLPQISQPAKLAEAFKYFVQGMGYMPSASMTRLMRSRTASGSSVTSLDGTRSRSHTSEGTRSRSHTSEGTRSRSHTSEGAHLDITPNSGAAGNSAGPKSMEVSC

SEQ ID NO: 55856 - protein, 95 aa, Homo sapiens
MSREMQDVDLAEVKPLVEKGETITGLLQEFDVQTKPATTPSSTTRTCRRSPSTLPSATWTPLASRTAQPPSPQGTCTPPWISWLKCFLESFNSLG

SEQ ID NO: 55857 - protein, 496 aa, Homo sapiens
MADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLGEVVNTHGPVEPDKDNIRQEPYTLPQGFTWDALDLGDRGVLKELYTLLNENYVEDDDNMFRFDYSPEFLLWALRPPGWLPQWHCGVRVVSSRKLVGFISAIPANIHIYDTEKKMVEINFLCVHKKLRSKRVAPVLIREITRRVHLEGIFQAVYTAGVVLPKPVGTCRYWHRSLNPRKLIEVKFSHLSRNMTMQRTMKLYRLPETPKTAGLRPMETKDIPVVHQLLTRYLKQFHLTPVMSQEEVEHWFYPQENIIDTFVVENANGEVTDFLSFYTLPSTIMNHPTHKSLKAAYSFYNVHTQTPLLDLMSDALVLAKMKGFDVFNALDLMENKTFLEKLKFGIGDGNLQYYLYNWKCPSMGAEKVGLVLQ

SEQ ID NO: 55858 - protein, 137 aa, Homo sapiens
MADESETAVKPPAPPLPQMMEGNGNGHEHCSDCENEEDNSYNRGGLSPANDTGAKKKKKKQKKKKEKGSETDSAQDQPVKMNSLPAERIQEIQKAIELFSVGQGPAKTMEEASKRSYQFWDTQPVPKLAKRTVHPPE

SEQ ID NO: 55859 - protein, 496 aa, Homo sapiens; identical to SEQ ID NO: 55857

SEQ ID NO: 55860 - protein, 529 aa, Homo sapiens
MAEDSESAASQQSLELDDQDTCGIDGDNEEETEHAKGSPGGYLGAKKKKKKQKRKKEKPNSGGTKSDSASDSQEIKIQQPSKHNTIWQQISAGAAMGSATMEGEWTGMRNDHKNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 55861 - protein, 485 aa, Homo sapiens
MRRRRSTPKEVLEGIWEPKRKRRNRREKRRNQIPEAPSQTRHLIPRRLKFSSLRNTTPSGSRFQREQPWNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 55862 - protein, 498 aa, Homo sapiens
MAEDSESAASQQSLELDDQDTCGIDGDNEEETEHAKGSPGGYLGAKKKKKKQKRKKEKPNSGGTKSDSASDSQEIKIQQPSKNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 55863 - protein, 77 aa, Homo sapiens
MSDALILAKSKGFDVFNALDLMENKTFLEKLKFGIGDGNLQYYLYNWRCPGTDSEKGSGNFVNANGKLLPDVCRRPP

SEQ ID NO: 55864 - protein, 485 aa, Homo sapiens
MASPWRGAHEVLEGIWEPKRKRRNRREKRRNQIPEAPSQTRHLIPRRLKFSSLRNTTPSGSRFQREQPWNPSVPMQKLQDIQRAMELLSACQGPARNIDEAAKHRYQFWDTQPVPKLDEVITSHGAIEPDKDNVRQEPYSLPQGFMWDTLDLSDAEVLKELYTLLNENYVEDDDNMFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 55865 - protein, 310 aa, Homo sapiens
MFRFDYSPEFLLWALRPPGWLLQWHCGVRVSSNKKLVGFISAIPANIRIYDSVKKMVEINFLCVHKKLRSKRVAPVLIREITRRVNLEGIFQAVYTAGVVLPKPIATCRYWHRSLNPRKLVEVKFSHLSRNMTLQRTMKLYRLPDVTKTSGLRPMEPKDIKSVRELINTYLKQFHLAPVMDEEEVAHWFLPREHIIDTFVVESPNGKLTDFLSFYTLPSTVMHHPAHKSLKAAYSFYNIHTETPLLDLMSDALILAKSKGFDVFNALDLMENKTFLEKLKFGIGDGNLQYYLYNWRCPGTDSEKVGLVLQ

SEQ ID NO: 55866 - protein, 574 aa, Homo sapiens
MEPTENPCQGPLGQKAGEKPLAAGPGEEELLRGSAPHAQDTQSEELPPSCTISGEKKPPAVSGEATGADAGRLCPPPRSRAPHKDRTLARSRPQTQGEDCSLPVGEVKIGKRSYSPAPGKQKKPNAMGLAPTSSPGAPNSARATHNPVPCGSGRGPCHLANLLSTLAQSNQNRDHKQGPPEVTCQIRKKTRTLYRSDQLEELEKIFQEDHYPDSDKRREIAQTVGVTPQRIMVWFQNRRAKWRKMEKLNGKESKDNPAAPGPASSQCSSAAEILPAVPMEPKPDPFPQESPLDTFPEPPMLLTSDQTLAPTQPSEGAQRVVTPPLFSPPPVRRADLPFPLGPVHTPQLMPLLMDVAGSDSSHKDGPCGSWGTSITLPPPCSYLEELEPQDYQQSNQPGPFQFSQAPQPPLFQSPQPKLPYLPTFPFSMPSSLTLPPPEDSLFMFPCGPSGGTSQGYCPGASSGQILMQPPAGNIGTASWSDPCLPELPFPGPFCPQALGHPPGGDGYFPDLFPTPCPQALGRQPSSALSWMPEGARPGTGPLLSKAKEEPPAASLDQPSALEEARGDDKNSHVP

SEQ ID NO: 55867 - protein, 691 aa, Homo sapiens
MALLLTLTSPDLEGTWDTRDKDGFKAQEGPPLAVPEFPVCGLYRIYGVCGSFSSFFIIRCSLCALETLKSPQHDPLEIPEQSLKLIPLVSGKRELTRGQKAGEKPLAAGPGEEELLRGSAPHAQDTQSEELPPSCTISGEKKPPAVSGEATGADAGRLCPPPRSRAPHKDRTLARSRPQTQGEDCSLPVGEVKIGKRSYSPAPGKQKKPNAMGLAPTSSPGAPNSARATHNPVPCGSGRGPCHLANLLSTLAQSNQNRDHKQGPPEVTCQIRKKTRTLYRSDQLEELEKIFQEDHYPDSDKRREIAQTVGVTPQRIMVKGAGSLVAGWSGGGPTIETLELQSERSAVAWVWFQNRRAKWRKMEKLNGKESKDNPAAPGPASSQCSSAAEILPAVPMEPKPDPFPQESPLDTFPEPPMLLTSDQTLAPTQPSEGAQRVVTPPLFSPPPVRRADLPFPLGPVHTPQLMPLLMDVAGSDSSHKDGPCGSWGTSITLPPPCSYLEELEPQDYQQSNQPGPFQFSQAPQPPLFQSPQPKLPYLPTFPFSMPSSLTLPPPEDSLFMFPCGPSGGTSQGYCPGASSGQILMQPPAGNIGTASWSDPCLPELPFPGPFCPQALGHPPGGDGYFPDLFPTPCPQALGRQPSSALSWMPEGARPGTGPLLSKAKEEPPAASLDQPSALEEARGDDKNSHVP

SEQ ID NO: 55868 - protein, 232 aa, Homo sapiens
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 55869 - protein, 329 aa, Homo sapiens
MGTAAAAAAAAAAAAAGEGARSPSPAAVSLGLGVAVVSSLVNGSTFVLQKKGIVRAKRRGTSYLTDIVWWAGTIAMAVGQIGNFLAYTAVPTVLVTPLGALGVPFGSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 55870 - protein, 254 aa, Homo sapiens
MAVGQIGNFLAYTAVPTVLVTPLGALGVPFGSILASYLLKEKLNILGKLGCLLSCAGSVVLIIHSPKSESVTTQAELEEKLTNPVFVGYLCIVLLMLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 55871 - protein, 159 aa, Homo sapiens
MLLLLIFWIAPAHGPTNIMVYISICSLLGSFTVPSTKGIGLAAQDILHNNPSSQRALCLCLVLLAVLGCSIIVQFRYINKALECFDSSVFGAIYYVVFTTLVLLASAILFREWSNVGLVDFLGMACGFTTVSVGIVLIQVFKEFNFNLGEMNKSNMKTD

SEQ ID NO: 55872 - protein, 254 aa, Homo sapiens; identical to SEQ ID NO: 55870

SEQ ID NO: 55873 - protein, 360 aa, Homo sapiens
MSQGRGKYDFYIGLGLAMSSSIFIGGSFILKKKGLLRLARKGSMRAGQGGHAYLKEWLWWAGLLSMGAGEVANFAAYAFAPATLVTPLGALSVLVSAILSSYFLNERLNLHGKIGCLLSILGSTVMVIHAPKEEEIETLNEMSHKLGDPGFVVFATLVVIVALILIFVVGPRHGQTNILVYITICSVIGAFSVSCVKGLGIAIKELFAGKPVLRHPLAWILLLSLIVCVSTQINYLNRALDIFNTSIVTPIYYVFFTTSVLTCSAILFKEWQDMPVDDVIGTLSGFFTIIVGIFLLHAFKDVSFSLASLPVSFRKDEKAMNGNLSNMYEVLNNNEESLTCGIEQHTGENVSRRNGNLTAF

SEQ ID NO: 55874 - protein, 341 aa, Homo sapiens
MSQGRGKYDFYIGLGLAMSSSIFIGGSFILKKKGLLRLARKGSMRAVGAGEVANFAAYAFAPATLVTPLGALSVLVSAILSSYFLNERLNLHGKIGCLLSILGSTVMVIHAPKEEEIETLNEMSHKLGDPGFVVFATLVVIVALILIFVVGPRHGQTNILVYITICSVIGAFSVSCVKGLGIAIKELFAGKPVLRHPLAWILLLSLIVCVSTQINYLNRALDIFNTSIVTPIYYVFFTTSVLTCSAILFKEWQDMPVDDVIGTLSGFFTIIVGIFLLHAFKDVSFSLASLPVSFRKDEKAMNGNLSNMYEVLNNNEESLTCGIEQHTGENVSRRNGNLTAF

SEQ ID NO: 55875 - protein, 360 aa, Homo sapiens; identical to SEQ ID NO: 55873

SEQ ID NO: 55876 - protein, 360 aa, Homo sapiens; identical to SEQ ID NO: 55873

SEQ ID NO: 55877 - protein, 341 aa, Homo sapiens; identical to SEQ ID NO: 55874

SEQ ID NO: 55878 - protein, 59 aa, Homo sapiens
MSQGRGKYDFYIGLGLAMSSSIFIGGSFILKKKGLLRLARKGSMRAGQGGHAYLKEWLW

SEQ ID NO: 55879 - protein, 299 aa, Homo sapiens
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTGTSGPLQRPQLSKVKRKKPRGLFS

SEQ ID NO: 55880 - protein, 316 aa, Homo sapiens
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVGQKHQGAGDPHTSNSASLQGIDSQCVNQPEQLVSSAPTLSAPEKESTALCRDLSCQRSRGRSQGVSSVNLLWPQLLRMDLENSFQASP

SEQ ID NO: 55881 - protein, 229 aa, Homo sapiens
MEELEQGLLMQPWAWLQLAENSLLAKVFITKQGYALLVSDLQQVWHEQVDTSVVSQRAKELNKRLTAPPAAFLCHLDNLLRPLLKDAAHPSEATFSCDCVADALILRVRSELSGLPFYWNFHCMLASPSLVSQHLIRPLMGMSLALQCQVRELATLLHMKDLEIQDYQESGATLIRDRLKTEPFEENSFLEQFMIEKLPEACSIGDGKPFVMNLQDLYMAVTTQEVQVG

SEQ ID NO: 55882 - protein, 267 aa, Homo sapiens
MANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 55883 - protein, 77 aa, Homo sapiens [sequence omitted]

SEQ ID NO: 55884 - protein, 77 aa, Homo sapiens [sequence omitted]

SEQ ID NO: 55885 - protein, 152 aa, Homo sapiens
MANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 55886 - protein, 152 aa, Homo sapiens; identical to SEQ ID NO: 55885

SEQ ID NO: 55887 - protein, 152 aa, Homo sapiens; identical to SEQ ID NO: 55885

SEQ ID NO: 55888 - protein, 152 aa, Homo sapiens; identical to SEQ ID NO: 55885

SEQ ID NO: 55889 - protein, 152 aa, Homo sapiens; identical to SEQ ID NO: 55885

SEQ ID NO: 55890 - protein, 292 aa, Homo sapiens
MVLLSTLGIVFQGEGPPISSCDTGTMANCERTFIAIKPDGVQRGLVGEIIKRFEQKGFRLVGLKFMQASEDLLKEHYVDLKDRPFFAGLVKYMHSGPVVAMVWEGLNVVKTGRVMLGETNPADSKPGTIRGDFCIQVGRTMANLERTFIAIKPDGVQRGLVGEIIKRFEQKGFRLVAMKFLRASEEHLKQHYIDLKDRPFFPGLVKYMNSGPVVAMVWEGLNVVKTGRVMLGETNPADSKPGTIRGDFCIQVGRNIIHGSDSVKSAEKEISLWFKPEELVDYKSCAHDWVYE

SEQ ID NO: 55891 - protein, 169 aa, Homo sapiens
MICLVLTIFANLFPAACTGAHERTFLAVKPDGVQRRLVGEIVRRFERKGFKLVALKLVQASEELLREHYAELRERPFYGRLVKYMASGPVVAMVWQGLDVVRTSRALIGATNPADAPPGTIRGDFCIEVGKNLIHGSDSVESARREIALWFRADELLCWEDSAGHWLYE

SEQ ID NO: 55892 - protein, 212 aa, Homo sapiens
MEISMPPPQIYVEKTLAIIKPDIVDKEEEIQDIILRSGFTIVQRRKLRLSPEQCSNFYVEKYGKMFFPNLTAYMSSGPLVAMILARHKAISYWLELLGPNNSLVAKETHPDSLRAIYGTDDLRNALHGSNDFAAAEREIRFMFPEVIVEPIPIGQAAKDYLNLHIMPTLLEGLTELCKQKPADPLIWLADWLLKNNPNKPKLCHHPIVEEPY

SEQ ID NO: 55893 - protein, 186 aa, Homo sapiens
MASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 55894 - protein, 194 aa, Homo sapiens
MTQNLGSEMASILRSPQALQLTLALIKPDAVAHPLILEAVHQQILSNKFLIVRMRELLWRKEDCQRFYREHEGRFFYQRLVEFMASGPIRAYILAHKDAIQLWRTLMGPTRVFRARHVAPDSIRGSFGLTDTRNTTHGSDSVVSASREIAAFFPDFSEQRWYEEEEPQLRCGPVCYSPEGGVHYVAGTGGLGPA

SEQ ID NO: 55895 - protein, 186 aa, Homo sapiens; identical to SEQ ID NO: 55893

SEQ ID NO: 55896 - protein, 119 aa, Homo sapiens
MASILRSPQALQLTLALIKPDAVAHPLILEAVHQQILSNKFLIVRMRELLWRKEDCQRFYREHEDSVVSASREIAAFFPDFSEQRWYEEEEPQLRCGPVCYSPEGGVHYVAGTGGLGPA

SEQ ID NO: 55897 - protein, 186 aa, Homo sapiens; identical to SEQ ID NO: 55893

SEQ ID NO: 55898 - protein, 163 aa, Homo sapiens
MASILRSPQALQLTLALIKPDAVAHPLILEAVHQQILSNKFLIVRMRELLWRKEDCQRFYREHEAGQSEPTSLPTRMPSSSGGRSWDPPECSEHAMWPQILSVGVSASLTPATPPMVRTLWFQPAERLQPSSLTSVNSAGMRRKSPSCAVALCAIAQREVSTM

SEQ ID NO: 55899 - protein, 186 aa, Homo sapiens; identical to SEQ ID NO: 55893

SEQ ID NO: 55900 - protein, 376 aa, Homo sapiens
MNHSERFVFIAEWYDPNASLLRRYELLFYPGDGSVEMHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 55901 - protein, 340 aa, Homo sapiens
MHDVKNHRTFLKRTKYDNLHLEDLFIGNKVNVFSRQLVLIDYGDQYTARQLGSRKEKTLALIKPDAISKAGEIIEIINKAGFTITKLKMMMLSRKEALDFHVDHQSRPFFNELIQFITTGPIIAMEILRDDAICEWKRLLGPANSGVARTDASESIRALFGTDGIRNAAHGPDSFASAAREMELFFPSSGGCGPANTAKFTNCTCCIVKPHAVSEGLLGKILMAIRDAGFEISAMQMFNMDRVNVEEFYEVYKGVVTEYHDMVTEMYSGPCVAMEIQQNNATKTFREFCGPADPEIARHLRPGTLRAIFGKTKIQNAVHCTDLPEDGLLEVQYFFKILDN

SEQ ID NO: 55902 - protein, 471 aa, Homo sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 55903 - protein, 471 aa, Homo sapiens; identical to SEQ ID NO: 55902

SEQ ID NO: 55904 - protein, 471 aa, Homo sapiens; identical to SEQ ID NO: 55902

SEQ ID NO: 55905 - protein, 248 aa, Homo sapiens [sequence omitted]

SEQ ID NO: 55906 - protein, 235 aa, Homo sapiens
  MOD_RES (1)..(1): Any amino acid
XPDITEEEMRKLFEKYGKAGEVFIHKDKGFGFIRLVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGT

SEQ ID NO: 55907 - protein, 124 aa, Homo sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKETRTLAEIAKVELDNMPLRGKQLRV

SEQ ID NO: 55908 - protein, 66 aa, Homo sapiens
MQSNKTFNLEKQNHTPRKHHQHHHQQQHHQQQQQQPPPPPIPANGQQASSQNEGLTIDLKNFRKPG

SEQ ID NO: 55909 - protein, 207 aa, Homo sapiens
MQSNKTFNLEKQNHTPRKHHQHHHQQQHHQQQQQQPPPPPIPANGQQASSQNEGLTIDLKNFRKPGEKTFTQRSRLFVGNLPPDITEEEMRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDR

SEQ ID NO: 55910 - protein, 382 aa, Homo sapiens
MRKLFEKYGKAGEVFIHKDKGFGFIRLETRTLAEIAKVELDNMPLRGKQLRVRFACHSASLTVRNLPQYVSNELLEEAFSVFGQVERAVVIVDDRGRPSGKGIVEFSGKPAARKALDRCSEGSFLLTTFPRPVTVEPMDQLDDEEGLPEKLVIKNQQFHKEREQPPRFAQPGSFEYEYAMRWKALIEMEKQQQDQVDRNIKEAREKLEMEMEAARHEHQVMLMRQDLMRRQEELRRMEELHNQEVQKRKQLELRQEEERRRREEEMRRQQEEMMRRQQEGFKGTFPDAREQEIRMGQMAMGGAMGINNRGAMPPAPVPAGTPAPPGPATMMPDGTLGLTPPTTERFGQAATMEGIGAIGGTPPAFNRAAPGAEFAPNKRRRY

SEQ ID NO: 55911 - protein, 1015 aa, Homo sapiens
MGAERRLLSIKEAFRLAQQPHQNQAKLVVALSRTYRTMDDKTVFHEEFIHYLKYVMVVYKREPAVERVIEFAAKFVTSFHQSDMEDDEEEEDGGLLNYLFTFLLKSHEANSNAVRFRVCLLINKLLGSMPENAQIDDDVFDKINKAMLIRLKDKIPNVRIQAVLALSRLQDPKDDECPVVNAYATLIENDSNPEVRRAVLSCIAPSAKTLPKIVGRTKDVKEAVRKLAYQVLAEKVHMRAMSIAQRVMLLQQGLNDRSDAVKQAMQKHLLQGWLRFSEGNILELLHRLDVENSSEVAVSVLNALFSITPLSELVGLCKNNDGRKLIPVETLTPEIALYWCALCEYLKSKGDEGEEFLEQILPEPVVYADYLLSYIQSIPVVNEEHRGDFSYIGNLMTKEFIGQQLILIIKSLDTSEEGGRKKLLAVLQEILILPTIPISLVSFLVERLLHIIIDDNKRTQIVTEIISEIRAPIVTVGVNNDPADVRKKELKMAEIKVKLIEAKEALENCITLQDFNRASELKEEIKALEDARINLLKETEQLEIKEVHIEKNDAETLQKCLILCYELLKQMSISTGLSATMNGIIESLILPGIISIHPVVRNLAVLCLGCCGLQNQDFARKHFVLLLQVLQIDDVTIKISALKAIFDQLMTFGIEPFKTKKIKTLHCEGTEINSDDEQESKEVEETATAKNVLKLLSDFLDSEVSELRTGAAEGLAKLMFSGLLVSSRILSRLILLWYNPVTEEDVQLRHCLGVFFPVFAYASRTNQECFEEAFLPTLQTLANAPASSPLAEIDITNVAELLVDLTRPSGLNPQAKTSQDYQALTVHDNLAMKICNEILTSPCSPEIRVYTKALSSLELSSHLAKDLLVLLNEILEQVKDRTCLRALEKIKIQLEKGNKEFGDQAEAAQDATLTTTTFQNEDEKNKEVYMTPLRGVKATQASKSTQLKTNRGQRKVTVSARTNRRCQTAEADSESDHEVPEPESEMKMRLPRRAKTAALEKSKLNLAQFLNEDLS

SEQ ID NO: 55912 - protein, 316 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDRDSLTLSPRLECSGTISTHCNLHLLDSSNSPASAS

SEQ ID NO: 55913 - protein, 385 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRMEESHQEATEKEVERILGLLQTYFREDPDTPMSFFDFVVDPHSFPRTVENIFHVSFIIRDGFARIRLDQDRLPVIEPVSINEENEGFEHNTQVRNQGIIALSYRDWEEIVKTFEISEPVITPSQRQQKPSA

SEQ ID NO: 55914 - protein, 172 aa, Homo sapiens [sequence omitted]

SEQ ID NO: 55915 - protein, 857 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVKVLEFGRKQGSSKEEQERKRLIHKHKREFKGAVREIRKDNQFLARMQLSEIMERDAERKRKVKQLFNSLATQEGEWKALKRKKFKK

SEQ ID NO: 55916 - protein, 806 aa, Homo sapiens
MAKAKKVGARRKASGAPAGARGGPAKANSNPFEVKVNRQKFQILGRKTRHDVGLPGVSRARALRKRTQTLLKEYKERDKSNVFRDKRFGEYNSNMSPEEKMMKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWASRLRAPTSTEANHIRLSCLAVGLALLKRCVLMYGSLPSFHAIMGPLQALLTDHLADCSHPQELQELCQSTLTEMESQKQLCRPLTCEKSKPVPLKLFTPRLVSNSRPQVIHLPWPPNYRCEPQHPAKKVIFFRVIML

SEQ ID NO: 55917 - protein, 857 aa, Homo sapiens; identical to SEQ ID NO: 55915

SEQ ID NO: 55918 - protein, 575 aa, Homo sapiens
MKRFALEQQRHHEKKSIYNLNEDEELTHYGQSLADIEKHNDIVDSDSDAEDRGTLSAELTAAHFGGGGGLLHKKTQQEGEEREKPKSRKELIEELIAKSKQEKRERQAQREDALELTEKLDQDWKEIQTLLSHKTPKSENRDKKEKPKPDAYDMMVRELGFEMKAQPSNRMKTEAELAKEEQEHLRKLEAERLRRMLGKDEDENVKKPKHMSADDLNDGFVLDKDDRRLLSYKDGKMNVEEDVQEEQSKEASDPESNEEEGDSSGGEDTEESDSPDSHLDLESNVESEEENEKPAKEQRQTPGKGLISGKERAGKATRDELPYTFAAPESYEELRSLLLGRSMEEQLLVVERIQKCNHPSLAEGNKAKLEKLFGFLLEYVGDLATDDPPDLTVIDKLVVHLYHLCQMFPESASDAIKFVLRDAMHEMEEMIETKGRAALPGLDVLIYLKITGLLFPTSDFWHPVVTPALVCLSQLLTKCPILSLQDVVKGLFVCCLFLEYVALSQRFIPELINFLLGILYIATPNKASQGSTLVHPFRALGKNSELLVVSAREDVATWQQSSLSLRWWSRIPDLR

SEQ ID NO: 55919 - protein, 767 aa, Homo sapiens
MGRRSRGRRLQQQQRPEDAEDGAEGGGKRGEAGWEGGYPEIVKENKLFEHYYQELKIVPEGEWGQFMDALREPLPATLRITGYKSHAKEILHCLKNKYFKELEDLEVDGQKVEVPQPLSWYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 55920 - protein, 531 aa, Homo sapiens
MVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 55921 - protein, 732 aa, Homo sapiens
MGRRSRGRRLQQQQRPEDAEDGAEGGGKRGEAGWEGGYPEIVKENKLFEHYYQELKIVPEGEWGQFMDALREPLPATLRITGYKRYPEELAWHTNLSRKILRKSPHLEKFHQFLVSETESGNISRQEAVSMIPPLLLNVRPHHKILDMCAAPGSKTTQLIEMLHADMNVPFPEGFVIANDVDNKRCYLLVHQAKRLSSPCIMVVNHDASSIPRLQIDVDGRKEILFYDRILCDVPCSGDGTMRKNIDVWKKWTTLNSLQLHGLQLRIATRGAEQLAEGGRMVYSTCSLNPIEDEAVIASLLEKSEGALELADVSNELPGLKWMPGITQWKVMTKDGQWFTDWDAVPHSRHTQIRPTMFPPKDPEKLQAMHLERCLRILPHHQNTGGFFVAVLVKKSSMPWNKRQPKLQGKSAETRESTQLSPADLTEGKPTDPSKLESPSFTGTGDTEIAHATEDLENNGSKKDGVCGPPPSKKMKLFGFKEDPFVFIPEDDPLFPPIEKFYALDPSFPRMNLLTRTTEGKKRQLYMVSKELRNVLLNNSEKMKVINTGIKVWCRNNSGEEFDCAFRLAQEGIYTLYPFINSRIITVSMEDVKILLTQENPFFRKLSSETYSQAKDLAKGSIVLKYEPDSANPDALQCPIVLCGWRGKASIRTFVPKNERLHYLRMMGLEVLGEKKKEGVILTNESAASTGQPDNDVTEGQRAGEPNSPDAEEANSPDVTAGCDPAGVHPPR

SEQ ID NO: 55922 - protein, 594 aa, Homo sapiens
MVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVREWYGYHFPELVKIINDNATYCRLAQFIGNRRELNEDKLEKLEELTMDGAKAKAILDASRSSMGMDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEMSEKPKKKKKQKPQEVPQENGMEDPSISFSKPKKKKSFSKEELMSSDLEETAGSTSIPKRKKSTPKEETVNDPEEAGHRSGSKKKRKFSKEEPVSSGPEEAVGKSSSKKKKKFHKASQED

SEQ ID NO: 55923 - protein, 225 aa, Homo sapiens
MDISAIDLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEGDRC

SEQ ID NO: 55924 - protein, 219 aa, Homo sapiens
  MOD_RES (1)..(1): Any amino acid
XLINIESFSSRVVSLSEYRQSLHTYLRSKMSQVAPSLSALIGEAVGARLIAHAGSLTNLAKYPASTVQILGAEKALFRALKTRGNTPKYGLIFHSTFIGRAAAKNKGRISRYLANKCSIASRIDCFSEVPTSVFGEKLREQVEERLSFYETGEIPRKNLDVMKEAMVQAEEAAAEITRKLEKQEKKRLKKEKKRLAALALASSENSSSTPEECEEGDRC

SEQ ID NO: 55925 - protein, 281 aa, Homo sapiens
MVLLHVLFEHAVGYALLALKEVEEISLLQPQVEESVLNLGKFHSIVRLVAFCPFASSQVALENANAVSEGVVHEDLRLLLETHLPSKKKKVLLGVGDPKIGAAIQEELGYNCQTGGVIAEILRGVRLHFHNLVKGLTDLSACKAQLGLGHSYSRAKVKFNVNRVDNMIIQSISLLDQLDKDINTFSMRVRQSRCGEGKAVALWFLMKQLGQGVTVALCREWYGYHFPELVKIINDNATYCRLAQFIGNRRELNEDKLEKLEELTMDGAKAKAILDASRSSM

SEQ ID NO: 55926 - protein, 133 aa, Homo sapiens
MRKHVLAASFSMLSLLVIMGDTDSKTDSSFIMDSDPRRCMRHHYVDSISHPLYKCSSKMVLLARCEGHCSQASRSEPLVSFSTVLKQPFRSSCHCCRPQTSKLKALRLRCSGGMRLTATYRYILSCHCEECNS

SEQ ID NO: 55927 - protein, 2471 aa, Homo sapiens
MPALRPALLWALLALWLCCAAPAHALQCRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPGFEGSTCERNIDDCPNHRCQNGGVCVDGVNTYNCRCPPQWTGQFCTEDVDECLLQPNACQNGGTCANRNGGYGCVCVNGWSGDDCSENIDDCAFASCTPGSTCIDRVASFSCMCPEGKAGLLCHLDDACISNPCHKGALCDTNPLNGQYICTCPQGYKGADCTEDVDECAMANSNPCEHAGKCVNTDGAFHCECLKGYAGPRCEMDINECHSDPCQNDATCLDKIGGFTCLCMPGFKGVHCELEINECQSNPCVNNGQCVDKVNRFQCLCPPGFTGPVCQIDIDDCSSTPCLNGAKCIDHPNGYECQCATGFTGVLCEENIDNCDPDPCHHGQCQDGIDSYTCICNPGYMGAICSDQIDECYSSPCLNDGRCIDLVNGYQCNCQPGTSGVNCEINFDDCASNPCIHGICMDGINRYSCVCSPGFTGQRCNIDIDECASNPCRKGATCINGVNGFRCICPEGPHHPSCYSQVNECLSNPCIHGNCTGGLSGYKCLCDAGWVGINCEVDKNECLSNPCQNGGTCDNLVNGYRCTCKKGFKGYNCQVNIDECASNPCLNQGTCFDDISGYTCHCVLPYTGKNCQTVLAPCSPNPCENAAVCKESPNFESYTCLCAPGWQGQRCTIDIDECISKPCMNHGLCHNTQGSYMCECPPGFSGMDCEEDIDDCLANPCQNGGSCMDGVNTFSCLCLPGFTGDKCQTDMNECLSEPCKNGGTCSDYVNSYTCKCQAGFDGVHCENNINECTESSCFNGGTCVDGINSFSCLCPVGFTGSFCLHEINECSSHPCLNEGTCVDGLGTYRCSCPLGYTGKNCQTLVNLCSRSPCKNKGTCVQKKAESQCLCPSGWAGAYCDVPNVSCDIAASRRGVLVEHLCQHSGVCINAGNTHYCQCPLGYTGSYCEEQLDECASNPCQHGATCSDFIGGYRCECVPGYQGVNCEYEVDECQNQPCQNGGTCIDLVNHFKCSCPPGTRGLLCEENIDDCARGPHCLNGGQCMDRIGGYSCRCLPGFAGERCEGDINECLSNPCSSEGSLDCIQLTNDYLCVCRSAFTGRHCETFVDVCPQMPCLNGGTCAVASNMPDGFICRCPPGFSGARCQSSCGQVKCRKGEQCVHTASGPRCFCPSPRDCESGCASSPCQHGGSCHPQRQPPYYSCQCAPPFSGSRCELYTAPPSTPPATCLSQYCADKARDGVCDEACNSHACQWDGGDCSLTMENPWANCSSPLPCWDYINNQCDELCNTVECLFDNFECQGNSKTCKYDKYCADHFKDNHCDQGCNSEECGWDGLDCAADQPENLAEGTLVIVVLMPPEQLLQDARSFLRALGTLLHTNLRIKRDSQGELMVYPYYGEKSAAMKKQRMTRRSLPGEQEQEVAGSKVFLEIDNRQCVQDSDHCFKNTDAAAALLASHAIQGTLSYPLVSVVSESLTPERTQLLYLLAVAVVIILFIILLGVIMAKRKRKHGSLWLPEGFTLRRDASNHKRREPVGQDAVGLKNLSVQVSEANLIGTGTSEHWVDDEGPQPKKVKAEDEALLSEEDDPIDRRPWTQQHLEAADIRRTPSLALTPPQAEQEVDVLDVNVRGPDGCTPLMLASLRGGSSDLSDEDEDAEDSSANIITDLVYQGASLQAQTDRTGEMALHLAARYSRADAAKRLLDAGADANAQDNMGRCPLHAAVAADAQGVFQILIRNRVTDLDARMNDGTTPLILAARLAVEGMVAELINCQADVNAVDDHGKSALHWAAAVNNVEATLLLLKNGANRDMQDNKEETPLFLAAREGSYEAAKILLDHFANRDITDHMDRLPRDVARDRMHHDIVRLLDEYNVTPSPPGTVLTSALSPVICGPNRSFLSLKHTPMGKKSRRPSAKSTMPTSLPNLAKEAKDAKGSRRKKSLSEKVQLSESSVTLSPVDSLESPHTYVSDTTSSPMITSPGILQASPNPMLATAAPPAPVHAQHALSFSNLHEMQPLAHGASTVLPSVSQLLSHHHIVSPGSGSAGSLSRLHPVPVPADWMNRMEVNETQYNEMFGMVLAPAEGTHPGIAPQSRPPEGKHITTPREPLPPIVTFQLIPKGSIAQPAGAPQPQSTCPPAVAGPLPTMYQIPEMARLPSVAFPTAMMPQQDGQVAQTILPAYHPFPASVGKYPTPPSQHSYASSNAAERTPSHSGHLQGEHPYLTPSPESPDQWSSSSPHSASDWSDVTTSPTPGGAGGGQRGPGTHMSEPPHNNMQVYA

SEQ ID NO: 55928 - protein, 236 aa, Homo sapiens [sequence omitted]

SEQ ID NO: 55929 - protein, 239 aa, Homo sapiens
CRDGYEPCVNEGMCVTYHNGTGYCKCPEGFLGEYCQHRDPCEKNRCQNGGTCVAQAMLGKATCRCASGFTGEDCQYSTSHPCFVSRPCLNGGTCHMLSRDTYECTCQVGFTGKECQWTDACLSHPCANGSTCTTVANQFSCKCLTGFTGQKCETDVNECDIPGHCQHGGTCLNLPGSYQCQCPQGFTGQYCDSLYVPCAPSPCVNGGTCRQTGDFTFECNCLPACWPRTPDLRLLLGEK

SEQ ID NO: 55930 - protein, 223 aa, Homo sapiens
MWICPGGGGGGGGGGDREDARPPLCCGRCWRSGCAARPPRMVSIGLRGAVRGARGCHLGRPFSPSVLLCVGRPGSAAGAERGHSLGSQEFGHRRGPLPWCPANRRGSPPSAPRGPGPLTRLLGRREAGSKSQKLLFRSARVQGGGQFCPSGSAFLGVEREPTAGLGGAERRNARFWRGERGQGRQAKRPAPSQPASPLPGGGTWAGCVGLVWMGTGFCGAPEF

SEQ ID NO: 55931 - protein, 863 aa, Homo sapiens [sequence omitted]

SEQ ID NO: 55932 - protein, 2321 aa, Homo sapiens
MGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQGPRCQQDVDECAGPAPCGPHGICTNLAGSFSCTCHGGYTGPSCDQDINDCDPNPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNASCAAAPCLHGGSCRPAPLAPFFRCACAQGWTGPRCEAPAAAPEVSEEPRCPRAACQAKRGDQRCDRECNSPGCGWDGGDCSLSVGDPWRQCEALQCWRLFNNSRCDPACSSPACLYDNFDCHAGGRERTCNPVYEKYCADHFADGRCDQGCNTEECGWDGLDCASEVPALLARGVLVLTVLLPPEELLRSSADFLQRLSAILRTSLRFRLDAHGQAMVFPYHRPSPGSEPRARRELAPEVIGSVVMLEIDNRLCLQSPENDHCFPDAQSAADYLGALSAVERLDFPYPLRDVRGEPLEPPEPSVPLLPLLVAGAVLLLVILVLGVMVARRKREHSTLWFPEGFSLHKDVASGHKGRREPVGQDALGMKNMAKGESLMGEVATDWMDTECPEAKRLKVEEPGMGAEEAVDCRQWTQHHLVAADIRVAPAMALTPPQGDADADGMDVNVRGPDGFTPLMLASFCGGALEPMPTEEDEADDTSASIISDLICQGAQLGARTDRTGETALHLAARYARADAAKRLLDAGADTNAQDHSGRTPLHTAVTADAQGVFQILIRNRSTDLDARMADGSTALILAARLAVEGMVEELIASHADVNAVDELGKSALHWAAAVNNVEATLALLKNGANKDMQDSKEETPLFLAAREGSYEAAKLLLDHFANREITDHLDRLPRDVAQERLHQDIVRLLDQPSGPRSPPGPHGLGPLLCPPGAFLPGLKAAQSGSKKSRRPPGKAGLGPQGPRGRGKKLTLACPGPLADSSVTLSPVDSLDSPRPFGGPPASPGGFPLEGPYAAATATAVSLAQLGGPGRAGLGRQPPGGCVLSLGLLNPVAVPLDWARLPPPAPPGPSFLLPLAPGPQLLNPGTPVSPQERPPPYLAVPGHGEEYPAAGAHSSPPKARFLRVPSEHPYLTPSPESPEHWASPSPPSLSDWSESTPSPATATGAMATTTGALPAQPLPLSVPSSLAQAQTQLGPQPEVTPKRQVLA

SEQ ID NO: 55933 - protein, 1288 aa, Homo sapiens
AAMGPGARGRRRRRRPMSPPPPPPPVRALPLLLLLAGPGAAAPPCLDGSPCANGGRCTQLPSREAACLCPPGWVGERCQLEDPCHSGPCAGRGVCQSSVVAGTARFSCRCPRGFRGPDCSLPDPCLSSPCAHGARCSVGPDGRFLCSCPPGYQGRSCRSDVDECRVGEPCRHGGTCLNTPGSFRCQCPAGYTGPLCENPAVPCAPSPCRNGGTCRQSGDLTYDCACLPGFEGQNCEVNVDDCPGHRCLNGGTCVDGVNTYNCQCPPEWTGQFCTEDVDECQLQPNACHNGGTCFNTLGGHSCVCVNGWTGESCSQNIDDCATAVCFHGATCHDRVASFYCACPMGKTGLLCHLDDACVSNPCHEDAICDTNPVNGRAICTCPPGFTGGACDQDVDECSIGANPCEHLGRCVNTQGSFLCQCGRGYTGPRCETDVNECLSGPCRNQATCLDRIGQFTCICMAGFTGTYCEVDIDECQSSPCVNGGVCKDRVNGFSCTCPSGFSGSTCQLDVDECASTPCRNGAKCVDQPDGYECRCAEGFEGTLCDRNVDDCSPDPCHHGRCVDGIASFSCACAPGYTGTRCESQVDECRSQPCRHGGKCLDLVDKYLCRCPSGTTGVNCEVNIDDCASNPCTFGVCRDGINRYDCVCQPGFTGPLCNVEINECASSPCGEGGSCVDGENGFRCLCPPGSLPPLCLPPSHPCAHEPCSHGICYDAPGGFRCVCEPGWSGPRCSQSLARDACESQPCRAGGTCSSDGMGFHCTCPPGVQGRQCELLSPCTPNPCEHGGRCESAPGQLPVCSCPQGWQDPCLNGGSCQDGVGSFSCSCLPGFAGPRCARDVDECLSNPCGPGTCTDHVASFTCTCPPGYGGFHCEQDLPDCSPSSCFNGGTCVDGVNSFSCLCRPGYTGAHCQHEADPCLSRPCLHGGVCSAAHPGFRCTCLESFTGPQCQTLVDWCSRQPCQNGGRCVQTGAYCLCPPGWSGRLCDIRSLPCREAAAQIGVRLEQLCQAGGQCVDEDSSHYCVCPEGRTGSHCEQEVDPCLAQPCQHGGTCRGYMGGYMCECLPGYNGDNCEDDVDECASQPCQHGGSCIDLVARYLCSCPPGTLGVLCEINEDDCGPGPPLDSGPRCLHNGTCVDLVGGFRCTCPPGYTGLRCEADINECRSGACHAAHTRDCLQDPGGGFRCLCHAGFSGPRCQTVLSPCESQPCQHGGQCRPSPGPGGGLTFTCHCAQPFWGPRCERVARSCRELQCPVGVPCQQTPRGPRCACPPGLSGPSCRSFPGSPPGASNAS

SEQ ID NO: 55934 - protein, 2003 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAKLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 55935 - protein, 1048 aa, Homo sapiens
CAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 55936 - protein, 2005 aa, Homo sapiens
MQPPSLLLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAQLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECEAQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 55937 - protein, 2003 aa, Homo sapiens
MQPPSLLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAQLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 55938 - protein, 186 aa, Homo sapiens
MSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGADAAIPGGAGRSGGSSPATAGAGGSPRAAGPGWASAGGRRSPT

SEQ ID NO: 55939 - protein, 2002 aa, Homo sapiens
MQPPSLLLLLLLLLLCVSVVRPRGLLCGSFPEPCANGGTCLSLSLGQGTCQCAPGFLGETCQFPDPCQNAQLCQNGGSCQALLPAPLGLPSSPSPLTPSFLCTCLPGFTGERCQAQLEDPCPPSFCSKRGRCHIQASGRPQCSCMPGWTGEQCQLRDFCSANPCVNGGVCLATYPQIQCHCPPGFEGHACERDVNECFQDPGPCPKGTSCHNTLGSFQCLCPVGQEGPRCELRAGPCPPRGCSNGGTCQLMPEKDSTFHLCLCPPGFIGPDCEVNPDNCVSHQCQNGGTCQDGLDTYTCLCPETWTGWDCSEDVDECETQGPPHCRNGGTCQNSAGSFHCVCVSGWGGTSCEENLDDCIAATCAPGSTCIDRVGSFSCLCPPGRTGLLCHLEDMCLSQPCHGDAQCSTNPLTGSTLCLCQPGYSGPTCHQDLDECLMAQQGPSPCEHGGSCLNTPGSFNCLCPPGYTGSRCEADHNECLSQPCHPGSTCLDLLATFHCLCPPGLEGQLCEVETNECASAPCLNHADCHDLLNGFQCICLPGFSGTRCEEDIDECRSSPCANGGQCQDQPGAFHCKCLPGFEGPRCQTEVDECLSDPCPVGASCLDLPGAFFCLCPSGFTGQLCEVPLCAPNLCQPKQICKDQKDKANCLCPDGSPGCAPPEDNCTCHHGHCQRSSCVCDVGWTGPECEAELGGCISAPCAHGGTCYPQPSGYNCTCPTGYTGPTCSEEMTACHSGPCLNGGSCNPSPGGYYCTCPPSHTGPQCQTSTDYCVSAPCFNGGTCVNRPGTFSCLCAMGFQGPRCEGKLRPSCADSPCRNRATCQDSPQGPRCLCPTGYTGGSCQTLMDLCAQKPCPRNSHCLQTGPSFHCLCLQGWTGPLCNLPLSSCQKAALSQGIDVSSLCHNGGLCVDSGPSYFCHCPPGFQGSLCQDHVNPCESRPCQNGATCMAQPSGYLCQCAPGYDGQNCSKELDACQSQPCHNHGTCTPKPGGFHCACPPGFVGLRCEGDVDECLDQPCHPTGTAACHSLANAFYCQCLPGHTGQWCEVEIDPCHSQPCFHGGTCEATAGSPLGFICHCPKGFEGPTCSHRAPSCGFHHCHHGGLCLPSPKPGFPPRCACLSGYGGPDCLTPPAPKGCGPPSPCLYNGSCSETTGLGGPGFRCSCPHSSPGPRCQKPGAKGCEGRSGDGACDAGCSGPGGNWDGGDCSLGVPDPWKGCPSHSRCWLLFRDGQCHPQCDSEECLFDGYDCETPPACTPAYDQYCHDHFHNGHCEKGCNTAECGWDGGDCRPEDGDPEWGPSLALLVVLSPPALDQQLFALARVLSLTLRVGLWVRKDRDGRDMVYPYPGARAEEKLGGTRDPTYQERAAPQTQPLGKETDSLSAGFVVVMGVDLSRCGPDHPASRCPWDPGLLLRFLAAMAAVGALEPLLPGPLLAVHPHAGTAPPANQLPWPVLCSPVAGVILLALGALLVLQLIRRRRREHGALWLPPGFTRRPRTQSAPHRRRPPLGEDSIGLKALKPKAEVDEDGVVMCSGPEEGEEVGQAEETGPPSTCQLWSLSGGCGALPQAAMLTPPQESEMEAPDLDTRGPDGVTPLMSAVCCGEVQSGTFQGAWLGCPEPWEPLLDGGACPQAHTVGTGETPLHLAARFSRPTAARRLLEAGANPNQPDRAGRTPLHAAVAADAREVCQLLLRSRQTAVDARTEDGTTPLMLAARLAVEDLVEELIAAQADVGARDKWGKTALHWAAAVNNARAARSLLQAGADKDAQDNREQTPLFLAAREGAVEVAQLLLGLGAARELRDQAGLAPADVAHQRNHWDLLTLLEGAGPPEARHKATPGREAGPFPRARTVSVSVPPHGGGALPRCRTLSAGAGPRGGGACLQARTWSVDLAARGGGAYSHCRSLSGVGAGGGPTPRGRRFSAGMRGPRPNPAIMRGRYGVAAGRGGRVSTDDWPCDWVALGACGSASNIPIPPPCLTPSPERGSPQLDCGPPALQEMPINQGGEGKK

SEQ ID NO: 55940 - protein, 2003 aa, Homo sapiens; identical to SEQ ID NO: 55934

SEQ ID NO: 55941 - protein, 186 aa, Homo sapiens; identical to SEQ ID NO: 55938

SEQ ID NO: 55942 - protein, 186 aa, Homo sapiens; identical to SEQ ID NO: 55938

SEQ ID NO: 55943 - protein, 186 aa, Homo sapiens; identical to SEQ ID NO: 55938

SEQ ID NO: 55944 - protein, 186 aa, Homo sapiens; identical to SEQ ID NO: 55938

SEQ ID NO: 55945 - protein, 186 aa, Homo sapiens; identical to SEQ ID NO: 55938

SEQ ID NO: 55946 - protein, 496 aa, Homo sapiens
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGIRYWNGVVPERCRRQFQEGEEWNCFFGYKVYPTLRCPVFVVQWLFDEAQLTVDNVHLTGQPVQEGLRLYIQNLGRELRHTLKDVPASFAPACLSHEIIIRSHWTDVQVKGTSLPRALHCWDRSLHDSHKASKTPLKGCPVHLVDSCPWPHCNPSCPTVRDQFTGQEMNVAQFLMHMGFDMQTVAQPQGLEPSELLGMLSNGS

SEQ ID NO: 55947 - protein, 295 aa, Homo sapiens
MGRGVRVLLLLSLLHCAGGSEGRKTWRRRGQQPPPPPRTEAAPAAGQPVESFPLDFTAVEGNMDSFMAQVKSLAQSLYPCSAQQLNEDLRLHLLLNTSVTCNDGSPAGYYLKESRGSRRWLLFLEGGWYCFNRENCDSRYDTMRRLMSSRDWPRTRTGTGILSSQPEENPYWWNANMVFIPYCSSDVWSGASSKSEKNEYAFMGALIIQEVVRELLGRGLSGAKVLLLAGSSAGGTGVLLNVDRVAEQLEKLGYPAIQVRGLADSGWFLDNKQYRHTDCVDTITCAPTEAIRRGI

SEQ ID NO: 55948 - protein, 1359 aa, Homo sapiens
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVLLLFLALFGVSLYSMCHISVGLDQELALPKDSYLLDYFLFLNRYFEVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLDTVAILSPRLEYSGTISAHCNLYLLDSTSRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 55949 - protein, 1332 aa, Homo sapiens
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVLLLFLALFGVSLYSMCHISVGLDQELALPKDSYLLDYFLFLNRYFEVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLASRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 55950 - protein, 1286 aa, Homo sapiens
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCSCQDCAASCPAIARPQALDSTFYLGQMPGSLVLIIILCSVFAVVTILLVGFRVAPARDKSKMVDPKKGTSLSDKLSFSTHTLLGQFFQGWGTWVASWPLTILVLSVIPVVALAAGLVFTELTTDPVELWSAPNSQARSEKAFHDQHFGPFFRTNQVILTAPNRSSYRYDSLLLGPKNFSGILDLDLLLELLELQERLRHLQVWSPEAQRNISLQDICYAPLNPDNTSLYDCCINSLLQYFQNNRTLLLLTANQTLMGQTSQVDWKDHFLYCANAPLTFKDGTALALSCMADYGAPVFPFLAIGGYKGKDYSEAEALIMTFSLNNYPAGDPRLAQAKLWEEAFLEEMRAFQRRMAGMFQVTFMAERSLEDEINRTTAEDLPIFATSYIVIFLYISLALGSYSSWSRVMVDSKATLGLGGVAVVLGAVMAAMGFFSYLGIRSSLVILQVVPFLVLSVGADNIFIFVLEYQRLPRRPGEPREVHIGRALGRVAPSMLLCSLSEAICFFLGALTPMPAVRTFALTSGLAVILDFLLQMSAFVALLSLDSKRQEASRLDVCCCVKPQELPPPGQGEGLLLGFFQKAYAPFLLHWITRGVVVGAPVYFVTTLGYNFSSEAGMNAICSSAGCNNFSFTQKIQYATEFPEQSYLAIPASSWVDDFIDWLTPSSCCRLYISGPNKDKFCPSTVNSLNCLKNCMSITMGSVRPSVEQFHKYLPWFLNDRPNIKCPKGGLAAYSTSVNLTSDGQVLASRFMAYHKPLKNSQDYTEALRAARELAANITADLRKVPGTDPAFEVFPYTITNVFYEQYLTILPEGLFMLSLCLVPTFAVSCLLLGLDLRSGLLNLLSIVMILVDTVGFMALWGISYNAVSLINLVSAVGMSVEFVSHITRSFAISTKPTWLERAKEATISMGSAVFAGVAMTNLPGILVLGLAKAQLIQIFFFRLNLLITLLGLLHGLVFLPVILSYVGPDVNPALALEQKRAEEAVAAVMVASCPNHPSRVSTADNIYVNHSFEGSIKGAGAISNFLPNNGRQF

SEQ ID NO: 55951 - protein, 260 aa, Homo sapiens
MPQNEYIELHRKRYGYRLDYHEKKRKKESREAHERSKKAKKMIGLKAKLYHKQRHAEKIQMKKTIKMHEKRNTKQKNDEKTPQGAVPAYLLDREGQSRAKVLSNMIKQKRKEKAGKWEVPLPKVRAQGETEVLKVIRTGKRKKKAWKRMVTKVCFVGDGFTRKPPKYERFIRPMGLRFKKAHVTHPELKATFCLPILGVKKNPSSPLYTTLGVITKGTVIEVNVSELGLVTQGGKVIWGKYAQVTNNPENDGCINAVLLV

SEQ ID NO: 55952 - protein, 502 aa, Homo sapiens
MSCPVPACCALLLVLGLCRARPRNALLLLADDGGFESGAYNNSAIATPHLDALARRSLLFRNAFTSVSSCSPSRASLLTGLPQHQNGMYGLHQDVHHFNSFDKVRSLPLLLSQAGVRTGIIGKKHVGPETVYPFDFAYTEENGSVLQVGRNITRIKLLVRKFLQTQDDRPFFLYVAFHDPHRCGHSQPQYGTFCEKFGNGESGMGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 55953 - protein, 299 aa, Homo sapiens
MGRIPDWTPQAYDPLDVLVPYFVPNTPAARADLAAQYTTVGRMDQGVGLVLQELRDAGVLNDTLVIFTSDNGIPFPSGRTNLYWPGTAEPLLVSSPEHPKRWGQVSEAYVSLLDLTPTILDWFSIPYPSYAIFGSKTIHLTGRSLLPALEAEPLWATVFGSQSHHEVTMSYPMRSVQHRHFRLVHNLNFKMPFPIDQDFYVSPTFQDLLNRTTAGQPTGWYKDLRHYYYRARWELYDRSRDPHETQNLATDPRFAQLLEMLRDQLAKWQWETHDPWVCAPDGVLEEKLSPQCQPLHNEL

SEQ ID NO: 55954 - protein, 205 aa, Homo sapiens
MSCPVPACCALLLVLGLCRARPRNALLLLADRALSVSHLTQRMTEALRVARTTTAPSPPRTWTPWPAAASSFAMPSPRSAAALPAAPASSLACPSIRMGCTGCTRTCTTSTPSTRCGACRCCSAKLVCAQASSGRSTWGRRPCTRLTLRTRRRMAPSSRWGGTSLELSCSSGNSCRLRMTGLSSSTSPSTTPTLWALPAPVRNLL

SEQ ID NO: 55955 - protein, 396 aa, Homo sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKVRAVGPGPHKGGPSWYPPEPGPCWRPGPHSVPSQAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 55956 - protein, 362 aa, Homo sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKAPRLEPLREEDLAKGPDLHILMAQRQVQVAEEGLQDFHRALRCYVDFTGAQSHCLHVSAQKMLDGASFTLYEFWQDEASWRRHQQSPGSKAFQRILIDHLRAPDTLTTVFFPASWWIMNNN

SEQ ID NO: 55957 - protein, 289 aa, Homo sapiens
MACAGLLTVCLLRPPAPQPQPQTPRHPQLAPDPGPAGHTLFQDVFRRADKNDDGKLSFEEFQNYFADGVLSLGELQELFSGIDGHLTDNLETEKLCDYFSEHLGVYRPVLAALESLNRAVLAAMDATKLEYERASKVDQFVTRFLLRETVSQLQALQSSLEGASDTLEAQAHGWRSDAESVEAQSRLCGSRRAGRRALRSVSRSSTWSPGSSDTGRSSEAEMQWRLQVNRLQELIDQLECKHILMAQRQVQVAEEGLQDFHRALRCYVDFTGAQSHCLHVSAQKMLDGA

SEQ ID NO: 55958 - protein, 140 aa, Homo sapiens
MASVDFKTYVDQACRAAEEFVNVYYTTMDKRRRLLSRLYMGTATLVWNGNAVSGQESLSEFFEMLPSSEFQISVVDCQPVHDEATPSQTTVLVVICGSVKFEGNKQRDFNQNFILTAQASPSNTVWKIASDCFRFQDWAS

SEQ ID NO: 55959 - protein, 327 aa, Homo sapiens
MAVPAKKRKMNFSEREVEIIVEELELKKHLLVNHFNAGVPLAAKSAAWHGILRRVNAVATCRRELPEVKKKWSDLKTEVRRKVAQVRAAVEGGEAPGPTEEDGAGGPGTGGGSGGGGPAVAPVLLTPMQQRICNLLGEATIISLPSTTEIHPVALGPSATAAAATVTLTQIPTETTYHTLEEGVVEYCTAEAPPPLPPETPVDMMAQHADTSVKPQALKSRIALNSAKLIQEQRVTNLHVKEIAQHLEQQNDLLQMIRRSQEVQACAQERQAQAMEGTQAALSVLIQVLRPMIKDFRRYLQSNTANPAPASDPGQVAQNGQPDSIIQ

SEQ ID NO: 55960 - protein, 494 aa, Homo sapiens
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQIEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPEALDFSDDEKEKEAKQRKKSQIQGRKKLKSEFNEPGEDFTEVHQNWNAHSSASEHAKGYRNREFTRGFSRARYPRSCHGRPPPQHFYNSEHMVSQETSGFPSQRQNNPIMPQYPFPLPVFDMHNFPLRPPPPPPPPPVNMGWATPNMAAHPLLNLPYSLPPPPPPPPLPPPPSSGDSNSHFGPYY

SEQ ID NO: 55961 - protein, 389 aa, Homo sapiens
MEVVEAAAAQLETLKFNGTDFGVGEGPAAPSPGSAPVPGTQPPLQSFEGSPDAGQTVEVKPAGEQPLQPVLNAVAAGTPAPQPQPPAESPACGDCVTSPGAAEPARAPDSLETSDSDSDSDSETDSDSSSSSSSSSSSSSSSSSSCISLPPVLSDGDDDLQIEKENKNFPLKTKDELLLNELPSVEELTIILPEDIELKPLGMVSSIIEQLVIIESMTNLPPVNEETVIFKSDRQAAGKIFEIFGPVAHPFYVLRFNSSDHIESKGIKIKETMYFAPSMKDFTQYIFTEKLKQDKGSDASWKNDQEPPPEALDFSDDEKEKEAKQRKKSQIQGRKKLKSEFNEPGTGISHRYCGLGSRPLQSSESHKLFGFQMHIKVTFTCYFSLLSMQ

SEQ ID NO: 55962 - protein, 114 aa, Homo sapiens
LASRLGPVSTANMSRPVRNRKVVDYSQFQESDDADFESEDSEDKDVKTKKDDSHSAEDSEDEKEDHKNVRQQRQAASKAASKQREMLMEDVGSEEEQEEEDEAPFQERKDSFSQ

SEQ ID NO: 55963 - protein, 243 aa, Homo sapiens
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 55964 - protein, 373 aa, Homo sapiens
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGNSYSPEEYALQQAADGTIFLVPRGTKMEATD

SEQ ID NO: 55965 - protein, 373 aa, Homo sapiens; identical to SEQ ID NO: 55964

SEQ ID NO: 55966 - protein, 373 aa, Homo sapiens; identical to SEQ ID NO: 55964

SEQ ID NO: 55967 - protein, 373 aa, Homo sapiens; identical to SEQ ID NO: 55964

SEQ ID NO: 55968 - protein, 343 aa, Homo sapiens
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLARYPLTESQLALVRDIRRRGKNKVAAQNCRKRKLETIVQLERELERLTNERERLLRARGEADRTLEVMRQQLTELYRDIFQHLRDESGN

SEQ ID NO: 55969 - protein, 742 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 55970 - protein, 772 aa, Homo sapiens
MLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 55971 - protein, 791 aa, Homo sapiens
FVFWKILKTKKHKHSGPSAMLSLKKYLTEGLLQFTILLSLIGVRVDVDTYLTSQLPPLREIILGPSSAYTQTQFHNLRNTLDGYGIHPKSIDLDNYFTARRLLSQVRALDRFQVPTTEVNAWLVHRDPEGSVSGSQPNSGLALESSSGLQDVTGPDNGVRESETEQGFGEDLEDLGAVAPPVSGDLTKEDIDLIDILWRQDIDLGAGREVFDYSHRQKEQDVEKELRDGGEQDTWAGEGAEALARNLLVDGETGESFPAQVPSGEDQTALSLEECLRLLEATCPFGENAEFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 55972 - protein, 616 aa, Homo sapiens
MTRLDRSSHSGGGHAKGSRPLNSLLAGHRVAQPASAPGSRASVQDIDLIDILWRQDIDLGAGREVFDYSHRQKEQDVEKELRDGGEQDTWAGEGAEALARNLLVDGETGESFPAQFPADISSITEAVPSESEPPALQNNLLSPLLTGTESPFDLEQQWQDLMSIMEMQAMEVNTSASEILYSAPPGDPLSTNYSLAPNTPINQNVSLHQASLGGCSQDFLLFSPEVESLPVASSSTLLPLAPSNSTSLNSTFGSTNLTGLFFPPQLNGTANDTAGPELPDPLGGLLDEAMLDEISLMDLAIEEGFNPVQASQLEEEFDSDSGLSLDSSHSPSSLSSSEGSSSSSSSSSSSSSSASSSASSSFSEEGAVGYSSDSETLDLEEAEGAVGYQPEYSKFCRMSYQDPAQLSCLPYLEHVGHNHTYNMAPSALDSADLPPPSALKKGSKEKQADFLDKQMSRDEHRARAMKIPFTNDKIINLPVEEFNELLSKYQLSEAQLSLIRDIRRRGKNKMAAQNCRKRKLDTILNLERDVEDLQRDKARLLREKVEFLRSLRQMKQKVQSLYQEVFGRLRDENGRPYSPSQYALQYAGDGSVLLIPRTMADQQARRQERKPKDRRK

SEQ ID NO: 55973 - protein, 605 aa, Homo sapiens
MMDLELPPPGLPSQQDMDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 55974 - protein, 589 aa, Homo sapiens
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 55975 - protein, 234 aa, Homo sapiens
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAF

SEQ ID NO: 55976 - protein, 280 aa, Homo sapiens
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNEVSSATFQSLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSIS

SEQ ID NO: 55977 - protein, 582 aa, Homo sapiens
MDLIDILWRQDIDLGVSREVFDFSQRRKEYELEKQKKLEKERQEQLQKEQEKAFFAQLQLDEETGEFLPIQPAQHIQSETSGSANYSQVAHIPKSDALYFDDCMQLLAQTFPFVDDNESLVPDIPGHIESPVFIATNQAQSPETSVAQVAPVDLDGMQQDIEQVWEELLSIPELQCLNIENDKLVETTMVPSPEAKLTEVDNYHFYSSIPSMEKEVGNCSPHFLNAFEDSFSSILSTEDPNQLTVNSLNSDATVNTDFGDEFYSAFIAEPSISNSMPSPATLSHSLSELLNGPIDVSDLSLCKAFNQNHPESTAEFNDSDSGISLNTSPSVASPEHSVESSSYGDTLLGLSDSEVEELDSAPGSVKQNGPKTPVHSSGDMVQPLSPSQGQSTHVHDAQCENTPEKELPVSPGHRKTPFTKDKHSSRLEAHLTRDELRAKALHIPFPVEKIINLPVVDFNEMMSKEQFNEAQLALIRDIRRRGKNKVAAQNCRKRKLENIVELEQDLDHLKDEKEKLLKEKGENDKSLHLLKKQLSTLYLEVFSMLRDEDGKPYSPSEYSLQQTRDGNVFLVPKSKKPDVKKN

SEQ ID NO: 55978 - protein, 694 aa, Homo sapiens
MKHLKRWWSAGGGLLHLTLLLSLAGLRVDLDLYLLLPPPTLLQDELLFLGGPASSAYALSPFSASGGWGRAGHLHPKGRELDPAAPPEGQLLREVRALGVPFVPRTSVDAWLVHSVAAGSADEAHGLLGAAAASSTGGAGASVDGGSQAVQGGGGDPRAARSGPLDAGEEEKAPAEPTAQVPDAGGCASEENGVLREKHEAVDHSSQHEENEERVSAQKENSLQQNDDDENKIAEKPDWEAEKTTESRNERHLNGTDTSFSLEDLFQLLSSQPENSLEGISLGDIPLPGSISDGMNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSEPFPWPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 55979 - protein, 399 aa, Homo sapiens
MNSSAHYHVNFSQAISQDVNLHEAILLCPNNTFRRDPTARTSQSQEPFLQLNSHTTNPEQTLPGTNLTGFLSPVDNHMRNLTSQDLLYDLDINIFDEINLMSLATEDNFDPIDVSQLFDEPDSDSGLSLDSSHNNTSVIKSNSSHSVCDEGAIGYCTDHESSSHHDLEGAVGGYYPEPSKLCHLDQSDSDFHGDLTFQHVFHNHTYHLQPTAPESTSNLFRPGKSQKIRSRYLEDTDRNLSRDEQRAKALHIPFSVDEIVGMPVDSFNSMLSRYYLTDLQVSLIRDIRRRGKNKVAAQNCRKRKLDIILNLEDDVCNLQAKKETLKREQAQCNKAINIMKQKLHDLYHDIFSRLRDDQGRPVNPNHYALQCTHDGSILIVPKELVASGHKKETQKGKRK

SEQ ID NO: 55980 - protein, 380 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAAGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 55981 - protein, 487 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAAGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 55982 - protein, 466 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 55983 - protein, 554 aa, Homo sapiens
MQMCRPASSSVLYVPTRWPGGCGATWQSCPSPPPRRTRIPQRPAVMYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 55984 - protein, 532 aa, Homo sapiens
MKLADSVMAGKASDGSIKWQLCYDISARTWWMDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 55985 - protein, 509 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 55986 - protein, 501 aa, Homo sapiens
MDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPTYSTPSTSPANRFVSVGPRDPSFVNIPQQTQSWYLG

SEQ ID NO: 55987 - protein, 498 aa, Homo sapiens
MYSPLCLTQDEFHPFIEALLPHVRAFAYTWFNLQARKRKYFKKHEKRMSKEEERAVKDELLSEKPEVKQKWASRLLAKLRKDIRPEYREDFVLTVTGKKPPCCVLSNPDQKGKMRRIDCLRQADKVWRLDLVMVILFKGIPLESTDGERLVKSPQCSNPGLCVQPHHIGVSVKELDLYLAYFVHAADSSQSESPSQPSDADIKDQPENGHLGFQDSFVTSGVFSVTELVRVSQTPIAAGTGPNFSLSDLESSSYYSMSPGAMRRSLPSTSSTSSTKRLKSVEDEMDSPGEEPFYTGQGRSPGSGSQSSGWHEVEPGMPSPTTLKKSEKSGFSSPSPSQTSSLGTAFTQHHRPVITGPRASPHATPSTLHFPTSPIIQQPGPYFSHPAIRYHPQETLKEFVQLVCPDAGQQAGQVGFLNPNGSSQGKVHNPFLPTPMLPPPPPPPMARPVPLPVPDTKPPTTSTEGGAASPTSPILVPGIKVAASHHPPDRPPDPFSTL

SEQ ID NO: 55988 - protein, 200 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQGKNFFSSNKCIKI

SEQ ID NO: 55989 - protein, 168 aa, Homo sapiens
MNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 55990 - protein, 446 aa, Homo sapiens
MERIPVSVDFWVVCCAVLKCNPGIPKRMSTLCFGFSDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 55991 - protein, 494 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEAYTASGTSQANRYVGLSPRDPSFLHQQQSWYLG

SEQ ID NO: 55992 - protein, 420 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQSWYLG

SEQ ID NO: 55993 - protein, 561 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEAYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 55994 - protein, 487 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQLRICDWTMNQNGRHLYPSTSEDTLGITWQSPGTWASLVPFQVSNRTPILPANVQNYGLNIIGEPFLQAETSN

SEQ ID NO: 55995 - protein, 570 aa, Homo sapiens
MMYSPICLTQDEFHPFIEALLPHVRAIAYTWFNLQARKRKYFKKHEKRMSKDEERAVKDELLSEKPEIKQKWASRLLAKLRKDIRQEYREDFVLTVTGKKHPCCVLSNPDQKGKIRRIDCLRQADKVWRLDLVMVILFKGIPLESTDGERLMKSPHCTNPALCVQPHHITVSVKELDLFLAYYVQEQDSGQSGSPSHNDPAKNPPGYLEDSFVKSGVFNVSELVRVSRTPITQGTGVNFPIGEIPSQPYYHDMNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEGEAASPTATTYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 55996 - protein, 309 aa, Homo sapiens
MNSGVNLQRSLSSPPSSKRPKTISIDENMEPSPTGDFYPSPSSPAAGSRTWHERDQDMSSPTTMKKPEKPLFSSASPQDSSPRLSTFPQHHHPGIPGVAHSVISTRTPPPPSPLPFPTQAILPPAPSSYFSHPTIRYPPHLNPQDTLKNYVPSYDPSSPQTSQPNGSGQVVGKVPGHFTPVLAPSPHPSAVRPVTLSMTDTKPITTSTEAYTASGTSQANRYVGLSPRDPSFLHQQQLRICDWTMNQNGRHLYPSTSEDTLGITWQSPGTWASLVPFQVSNRTPILPANVQNYGLNIIGEPFLQAETSN

SEQ ID NO: 55997 - protein, 423 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGP

SEQ ID NO: 55998 - protein, 428 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPSWYLG

SEQ ID NO: 55999 - protein, 508 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPSYSPPDTSPANRSFVGLGPRDPAGIYQAQSWGDG

SEQ ID NO: 56000 - protein, 406 aa, Homo sapiens
MDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPPTLRPTRPLQTVPLWD

SEQ ID NO: 56001 - protein, 430 aa, Homo sapiens
MDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPPTLRPTRPLQTVPLWD

SEQ ID NO: 56002 - protein, 499 aa, Homo sapiens
MDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGHLAYDLNPASTGLRRTLPSTSSSGSKRHKSGSMEEDVDTSPGGDYYTSPSSPTSSSRNWTEDMEGGISSPVKKTEMDKSPFNSPSPQDSPRLSSFTQHHRPVIAVHSGIARSPHPSSALHFPTTSILPQTASTYFPHTAIRYPPHLNPQDPLKDLVSLACDPASQQPGPLNGSGQLKMPSHCLSAQMLAPPPPGLPRLALPPATKPATTSEGGATSPTSPSYSPPDTSPANRSFVGLGPRDPAGIYQAQSWYLG

SEQ ID NO: 56003 - protein, 499 aa, Homo sapiens; identical to SEQ ID NO: 56002

SEQ ID NO: 56004 - protein, 403 aa, Homo sapiens
MGATEPGGDTSSDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGSPRATASALHFPSTSIIQQSSPYFTHPTIRYHHHHGQDSLKEFVQFVCSDGSGQATGQHSQRQAPPLPTGLSASDPGTATF

SEQ ID NO: 56005 - protein, 460 aa, Homo sapiens
MLPACRLQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGSPRATASALHFPSTSIIQQSSPYFTHPTIRYHHHHGQDSLKEFVQFVCSDGSGQATGQPNGSGQGKVPGSFLLPPPPPVARPVPLPMPDSKSTSTAPDGAALTPPSPSFATTGASSANRFVSIGPRDGNFLNIPQQSQSWFL

SEQ ID NO: 56006 - protein, 441 aa, Homo sapiens
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQHSQRQAPPLPTGLSASDPGTATF

SEQ ID NO: 56007 - protein, 502 aa, Homo sapiens
MYSPYCLTQDEFHPFIEALLPHVRAFSYTWFNLQARKRKYFKKHEKRMSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVRVSQTPVATASGPNFSLADLESPSYYNINQVTLGRRSITSPPSTSTTKRPKSIDDSEMESPVDDVFYPGTGRSPAAGSSQSSGWPNDVDAGPASLKKSGKLDFCSALSSQGSSPRMAFTHHPLPVLAGVRPGSPRATASALHFPSTSIIQQSSPYFTHPTIRYHHHHGQDSLKEFVQFVCSDGSGQATGQPNGSGQGKVPGSFLLPPPPPVARPVPLPMPDSKSTSTAPDGAALTPPSPSFATTGASSANRFVSIGPRDGNFLNIPQQSQSWFL

SEQ ID NO: 56008 - protein, 210 aa, Homo sapiens
MSKDEERAVKDELLGEKPEIKQKWASRLLAKLRKDIRPEFREDFVLTITGKKPPCCVLSNPDQKGKIRRIDCLRQADKVWRLDLVMVILFKGIPLESTDGERLYKSPQCSNPGLCVQPHHIGVTIKELDLYLAYFVHTPESGQSDSSNQQGDADIKPLPNGHLSFQDCFVTSGVWNVTELVYHRLLLQQHQGPTSPWRTWRVPATTTSTR

SEQ ID NO: 56009 - protein, 356 aa, Homo sapiens
MAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGDEYDDIVVHSSRSQTRLPPTPASKPLPDDPRPV

SEQ ID NO: 56010 - protein, 306 aa, Homo sapiens
MNGATAAWAPWVRTQRPPEDLGWARSWARGCRGLPSSSATSLRMGTRFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGVSQEERQGSPAGGSG

SEQ ID NO: 56011 - protein, 361 aa, Homo sapiens
LQNSRQSPATGGRLRGAPEAAGAMAGVACLGKAADADEWCDSGLGSLGPDAAAPGGPGLGAELGPGLSWAPLVFGYVTEDGDTALHLAVIHQHEPFLDFLLGFSAGTEYMDLQNDLGQTALHLAAILGETSTVEKLYAAGAGLCVAERRGHTALHLACRVGAHACARALLQPRPRRPREAPDTYLAQGPDRTPDTNHTPVALYPDSDLEKEEEESEEDWKLQLEAENYEGHTPLHVAVIHKDVEMVRLLRDAGADLDKPEPTCGRSPLHLAVEAQAADVLELLLRAGANPAARMYGGRTPLGSAMLRPNPILARLLRAHGAPEPEGEDEKSGPCSSSSDSDSGDEGVSQEERQGSPAGGSG

SEQ ID NO: 56012 - protein, 596 aa, Homo sapiens
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 56013 - protein, 718 aa, Homo sapiens
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 56014 - protein, 618 aa, Homo sapiens
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQIRRILKGKSIQQRAPPY

SEQ ID NO: 56015 - protein, 110 aa, Homo sapiens
MIVDKLLDDSRGGEGLRDAAGGCGLMTSPLNLSYFYGASPPAAAPGACDASCSVLGPSAPGSPGSDSSDFSSASSVSSCGAVESRSRGGARAERQPVEPHMGVGRQQRGP

SEQ ID NO: 56016 - protein, 601 aa, Homo sapiens
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPVSLNTVQVSWLNPVVVPQSSPAEQCQDFHGGQVFSPPQKCQPFQVRGSQQMIDQASLYQYSPQNQHVEQQPHYTHKPTLEYSPFPIPPQSPAYEPNLFDGPESQFCPNQSLVSLLGDQRESENIANPMQTSSSVQQQNDAHLHSFSMMPSSACEAMVGHEMASDSSNTSLPFSNMGNPMNTTQLGKSLFQWQVEQEESKLANISQDQFLSKDADGDTFLHIAVAQGRRALSYVLARKMNALHMLDIKEHNGQSAFQVAVAANQHLIVQDLVNIGAQVNTTDCWGRTPLHVCAEKGHSQVLQAIQKGAVGSNQFVDLEATNYDGLTPLHCAVIAHNAVVHELQRNQQPHSPEVQELLLKNKSLVDTIKCLIQMGAAVEAKDRKSGRTALHLAAEEANLELIRLFLELPSCLSFVNAKAYNGNTALHVAASLQYRLTQLDAVRLLMRKGADPSTRNLENEQPVHLVPDGPVGEQ

SEQ ID NO: 56017 - protein, 130 aa, Homo sapiens
MGVGRQQRGPFQGVRVKNSVKELLLHIRSHKQKASGQAVDDFKTQGVNIEQFRELKNTVSYSGKRKGPDSLSDGPACKRPALLHSQFLTPPQTPTPGESMEDVHLNEPKQESSADLLQNIINIKNECSPV

SEQ ID NO: 56018 - protein, 366 aa, Homo sapiens
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGDASHETQEPESFSAWSDRLAREHAQKCQQQQREAEGSRRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 56019 - protein, 358 aa, Homo sapiens
MASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSRRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 56020 - protein, 381 aa, Homo sapiens
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSRRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 56021 - protein, 366 aa, Homo sapiens [sequence omitted]

SEQ ID NO: 56022 - protein, 358 aa, Homo sapiens
MASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 56023 - protein, 381 aa, Homo sapiens
MSNPSPQVPEEEASTSVCRPKSSMASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEEELRESRARRAQEALGDREPKPTRAGPREEHPRGAGRGSLWRFGDVPWPCPGGGDPEAMAAALVARGPPLEEQGALRRYLRVQQVRWHPDRFLQRFRSQIETWELGRVMGAVTALSQALNRHAEALK

SEQ ID NO: 56024 - protein, 366 aa, Homo sapiens [sequence omitted]

SEQ ID NO: 56025 - protein, 381 aa, Homo sapiens; identical to SEQ ID NO: 56023

SEQ ID NO: 56026 - protein, 366 aa, Homo sapiens [sequence omitted]

SEQ ID NO: 56027 - protein, 366 aa, Homo sapiens [sequence omitted]

SEQ ID NO: 56028 - protein, 381 aa, Homo sapiens; identical to SEQ ID NO: 56023

SEQ ID NO: 56029 - protein, 358 aa, Homo sapiens; identical to SEQ ID NO: 56022

SEQ ID NO: 56030 - protein, 366 aa, Homo sapiens [sequence omitted]

SEQ ID NO: 56031 - protein, 358 aa, Homo sapiens; identical to SEQ ID NO: 56022

SEQ ID NO: 56032 - protein, 381 aa, Homo sapiens; identical to SEQ ID NO: 56023

SEQ ID NO: 56033 - protein, 358 aa, Homo sapiens; identical to SEQ ID NO: 56022

SEQ ID NO: 56034 - protein, 381 aa, Homo sapiens; identical to SEQ ID NO: 56023

SEQ ID NO: 56035 - protein, 366 aa, Homo sapiens [sequence omitted]

SEQ ID NO: 56036 - protein, 358 aa, Homo sapiens; identical to SEQ ID NO: 56022

SEQ ID NO: 56037 - protein, 381 aa, Homo sapiens; identical to SEQ ID NO: 56023

SEQ ID NO: 56038 - protein, 358 aa, Homo sapiens; identical to SEQ ID NO: 56022

SEQ ID NO: 56039 - protein, 232 aa, Homo sapiens
MASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSRRPPRAEGSSQSWRQQEEEQRLFRERARAKEE

SEQ ID NO: 56040 - protein, 232 aa, Homo sapiens
MASTSRRQRRERRFRRYLSAGRLVRAQALLQRHPGLDVDAGQPPPLHRACARHDAPALCLLLRLGADPAHQDRHGDTALHAAARQGPDAYTDFFLPLLSRCPSAMGIKNKDGETPGQILGWGPPWDSAEEEEEDDASKEREWRQKLQGELEDEWQEVMGRFEGDASHETQEPESFSAWSDRLAREHAQKCQQQQREAEGSCRPPRAEGSSQSWRQQEEEQRLFRERARAKEE

SEQ ID NO: 56041 - protein, 232 aa, Homo sapiens; identical to SEQ ID NO: 56040

SEQ ID NO: 56042 - protein, 232 aa, Homo sapiens; identical to SEQ ID NO: 56040

SEQ ID NO: 56043 - protein, 232 aa, Homo sapiens; identical to SEQ ID NO: 56040

SEQ ID NO: 56044 - protein, 232 aa, Homo sapiens; identical to SEQ ID NO: 56040

SEQ ID NO: 56045 - protein, 232 aa, Homo sapiens; identical to SEQ ID NO: 56040

SEQ ID NO: 56046 - protein, 1299 aa, Homo sapiens [sequence omitted]

SEQ ID NO: 56047 - protein, 1299 aa, Homo sapiens [sequence omitted]

SEQ ID NO: 56048 - protein, 1299 aa, Homo sapiens [sequence omitted]

SEQ ID NO: 56049 - protein, 1324 aa, Homo sapiens
MHVFVQSTCGEETMDSLDHMLTDPLELGPCGDGHGTRIMEDCLLGGTRVSLPEDLLEDPEIFFDVVSLSTWQEVLSDSQREHLQQFLPQFPEDSAEQQNELILALFSGENFRFGNPLHIAQKLFRDGHFNPEVVKYRQLCFKSQYKRYLNSQQQYFHRLLKQILASRSDLLEMARRSGPALPFRQKRPSPSRTPEEREWRTQQRYLKVLREVKEECGDTALSSDEEATLDLQEQFSFEDLSSWLPSSPARSPSPAVPLRVVPTLSTTDMKTADKVELGDSDLKIMLKKHHEKRKHQPDHPDLLTGDLTLNDIMTRVNAGRKGSLAALYDLAVLKKKVKEKEEKKKKKIKTIKSEAEDLAEPLSSTEGVAPLSQAPSPLAIPAIKEEPLEDLKPCLGINEISSSFFSLLLEILLLESQASLPMLEERVLDWQSSPASSLNSWFSAAPNWAELVLPALQYLAGESRAVPSSFSPFVEFKEKTQQWKLLGQSQDNEKELAALFQLWLETKDQAFCKQENEDSSDATTPVPRVRTDYVVRPSTGEEKRVFQEQERYRYSQPHKAFTFRMHGFESVVGPVKGVFDKETSLNKAREHSLLRSDRPAYVTILSLVRDAAARLPNGEGTRAEICELLKDSQFLAPDVTSTQVNTVVSGALDRLHYEKDPCVKYDIGRKLWIYLHRDRSEEEFERIHQAQAAAAKARKALQQKPKPPSKVKSSSKESSIKVLSSGPSEQSQMSLSDSSMPPTPVTPVTPTTPALPAIPISPPPVSAVNKSGPSTVSEPAKSSSGVLLVSSPTMPHLGTMLSPASSQTAPSSQAAARVVSHSGSAGLSQVRVVAQPSLPAVPQQSGGPAQTLPQMPAGPQIRVPATATQTKVVPQTVMATVPVKAQTTAATVQRPGPGQTGLTVTSLPATASPVSKPATSSPGTSAPSASTAAVIQNVTGQNIIKQVAITGQLGVKPQTGNSIPLTATNFRIQGKDVLRLPPSSITTDAKGQTVLRITPDMMATLAKSQVTTVKLTQDLFGTGGNTTGKGISATLHVTSNPVHAADSPAKASSASAPSSTPTGTTVVKVTPDLKPTEASSSAFRLMPALGVSVADQKGKSTVASSEAKPAATIRIVQGLGVMPPKAGQTITVATHAKQGASVASGSGTVHTSAVSLPSMNAAVSKTVAVASGAASTPISISTGAPTVRQVPVSTTVVSTSQAGKLPTRITVPLSVISQPMKGKSVVTAPIIKGNLGANLSGLGRNIILTTMPAGTKLIAGNKPVSFLTAQQLQQLQQQGQATQVRIQTVPASHLQQGTASGSSKAVSTVVVTTAPSPKQAPEQQ

SEQ ID NO: 56050 - protein, 462 aa, Homo sapiens
MQLRKMQTVKKEQASLDASSNVDKMMVLNSALTEVSEDSTTGEELLLSEGSVGKNKSSACRRKREFIPDEKKDAMYWEKRRKNNEAAKRSREKRRLNDLVLENKLIALGEENATLKAELLSLKLKFGLISSTAYAQEIQKLSNSTAVYFQDYQTSKSNVSSFVDEHEPSMVSSSCISVIKHSPQSSLSDVSEVSSVEHTQESSVQGSCRSPENKFQIIKQEPMELESYTREPRDDRGSYTASIYQNYMGNSFSGYSHSPPLLQVNRSSSNSPRTSETDDGVVGKSSDGEDEQQVPKGPIHSPVELKHVHATVVKVPEVNSSALPHKLRIKAKAMQIKVEAFDNEFEATQKLSSPIDMTSKRHFELEKHSAPSMVHSSLTPFSVQVTNIQDWSLKSEHWHQKELSGKTQNSFKTGVVEMKDSGYKVSDPENLYLKQGIANLSAEVVSLKRLIATQPISASDSG

SEQ ID NO: 56051 - protein, 462 aa, Homo sapiens; identical to SEQ ID NO: 56050

SEQ ID NO: 56052 - protein, 495 aa, Homo sapiens
MAEPTSDFETPIGWHASPELTPTLGPLSDTAPPRDSWMFWAMLPPPPPPLTSSLPAAGSKPSSESQPPMEAQSLPGAPPPFDAQILPGAQPPFDAQSPLDSQPQPSGQPWNFHASTSWYWRQSSDRFPRHQKSFNPAVKNSYYPRKYDAKFTDFSLPPSRKQKKKKRKEPVFHFFCDTCDRGFKNQEKYDKHMSEHTKCPELDCSFTAHEKIVQFHWRNMHAPGMKKIKLDTPEEIARWREERRKNYPTLANIERKKKLKLEKEKRGAVLTTTQYGKMKGMSRHSQMAKIRSPGKNHKWKNDNSRQRAVTGSGSHLCDLKLEGPPEANADPLGVLINSDSESDKEEKPQHSVIPKEVTPALCSLMSSYGSLSGSESEPEETPIKTEADVLAENQVLDSSAPKSPSQDVKATVRNFSEAKSENRKKSFEKTNPKRKKDYHNYQTLFEPRTHHPYLLEMLLAPDIRHERNVILQCVRYIIKKDFFGLDTNSAKSKDV

SEQ ID NO: 56053 - protein, 695 aa, Homo sapiens
MEEKPGQPQPQHHHSHHHPHHHPQQQQQQPHHHHHYYFYNHSHNHHHHHHHQQPHQYLQHGAEGSPKAQPKPLKHEQKHTLQQHQETPKKKTGYGELNGNAGEREISLKNLSSDEATNPISRVLNGNQQVVDTSLKQTVKANTFGKAGIKTKNFIQKNSMDKKNGKSYENKSGENQSVDKSDTIPIPNGVVTNNSGYITNGYMGKGADNDGSGSESGYTTPKKRKARRNSAKGCENLNIVQDKIMQQETSVPTLKQGLETFKPDYSEQKGNRVDGSKPIWKYETGPGGTSRGKPAVGDMLRKSSDSKPGVSSKKFDDRPKGKHASAVASKEDSWTLFKPPPVFPVDNSSAKIVPKISYASKVKENLNKTIQNSSVSPTSSSSSSSSTGETQTQSSSRLSQVPMSALKSVTSANFSNGPVLAGTDGNVYPPGGQPLLTTAANTLTPISSGTDSVLQDMSLTSAAVEQIKTSLFIYPSNMQTMLLSTAQVDLPSQTDQQNLGDIFQNQWGLSFINEPSAGPETVTGKSSEHKVMEVTFQGEYPATLVSQGAEIIPSGTEHPVFPKAYELEKRTSPQVLGSILKSGTTSESGALSLEPSHIGDLQKADTSSQGALVFLSKDYEIESQNPLASPTNTLLGSAKEQRYQRGLERNDSWGSFDLRAAIVYHTKEMESIWNLQKQDPKRIITYNEAMDSPDQ

SEQ ID NO: 56054 - protein, 979 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 56055 - protein, 2101 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 56056 - protein, 1664 aa, Homo sapiens
MLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 56057 - protein, 75 aa, Homo sapiens
MTLHATRGAALLSWVNSLHVADPVEAVLQLQDCSIFIKIIDRIHGTEEGQQILKQPVSERLDFVCSFLQKNRKHP

SEQ ID NO: 56058 - protein, 91 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGS

SEQ ID NO: 56059 - protein, 2115 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEAKEKVAGIESHSELQISRQQNELAELHANLARALQQVQEKEVRAQKLADDLSTLQEKMAATSKEVARLETLVRKAGEQQETASRELVKEPARAGDRQPEWLEEQQGRQFCSTQAALQAMEREAEQMGNELERLRAALMESQGQQQEERGQQEREVARLTQERGRAQADLALEKAARAELEMRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEQLEVFQREQTKQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 56060 - protein, 109 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMS

SEQ ID NO: 56061 - protein, 61 aa, Homo sapiens
MTLHATRGAALLSWVNSLHVADPVEAVLQLQDCSIFIKIIDRIHGTEEGQQILKQPVSERL

SEQ ID NO: 56062 - protein, 59 aa, Homo sapiens
MTLHATRGAALLSWVNSLHVADPVEAVLQLQDCSIFIKIIDRIHGTEEGQQILKQPVSE

SEQ ID NO: 56063 - protein, 146 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNED

SEQ ID NO: 56064 - protein, 1088 aa, Homo sapiens
MRLQNALNEQRVEFATLQEALAHALTEKEGKDQELAKLRGLEAAQIKELEELRQTVKQLKEQLAKKEKEHASGSGAQSEAAGRTEPTGPKLEALRAEVSKLEQQCQKQQEQADSLERSLEAERASRAERDSALETLQGQLEEKAQELGHSQSALASAQRELAAFRTKVQDHSKAEDEWKAQVARGRQEAERKNSLISSLEEEVSILNRQVLEKEGESKELKRLVMAESEKSQKLEERLRLLQAETASNSARAAERSSALREEVQSLREEAEKQRVASENLRQELTSQAERAEELGQELKAWQEKFFQKEQALSTLQLEHTSTQALVSELLPAKHLCQQLQAEQAAAEKRHREELEQSKQAAGGLRAELLRAQRELGELIPLRQKVAEQERTAQQLRAEKASYAEQLSMLKKAHGLLAEENRGLGERANLGRQFLEVELDQAREKYVQELAAVRADAETRLAEVQREAQSTARELEVMTAKYEGAKVKVLEERQRFQEERQKLTAQVEELSKKLADSDQASKVQQQKLKAVQAQGGESQQEAQRLQAQLNELQAQLSQKEQAAEHYKLQMEKAKTHYDAKKQQNQELQEQLRSLEQLQKENKELRAEAERLGHELQQAGLKTKEAEQTCRHLTAQVRSLEAQVAHADQQLRDLGKFQVATDALKSREPQAKPQLDLSIDSLDLSCEEGTPLSITRHKALMTIIPDLSPNNPLSKLPRTQPDGTSVPGEPASPISQRLPPKVESLESLYFTPIPARSQAPLESSLDSLGDVFLDSGRKTRSARRRTTQIINITMTKKLDVEEPDSANSSFYSTRSAPASQASLRATSSTQSLARLGSPDYGNSALLSLPGYRPTTRSSARRSQAGVSSGAPPGRNSFYMGTCQDEPEQLDDWNRIAELQQRNRVCPPHLKTCYPLESRPSLSLGTITDEEMKTGDPQETLRRASMQPIQIAEGTGITTRQQRKRVSLEPHQGPGTPESKKATSCFPRPMTPRDRHEGRKQSTTEAQKKAAPASTKQADRRQSMAFSILNTPKKLGNSLLRRGASKKALSKASPNTRSGTRRSPRIATTTASAATAAAIGATPRAKGKAKH

SEQ ID NO: 56065 - protein, 691 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKE

SEQ ID NO: 56066 - protein, 159 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPST

SEQ ID NO: 56067 - protein, 72 aa, Homo sapiens
MTLHATRGAALLSWVNSLHVADPVEAVLQLQDCSIFIKIIDRIHGTEEGQQILKQPVSERLDFVCSFLQKNR

SEQ ID NO: 56068 - protein, 83 aa, Homo sapiens
MTLHATRGAALLSWVNSLHVADPVEAVLQLQDCSIFIKIIDRIHGTEEGQQILKQPVSERLDFVCSFLQKNRKHPSSPECLVS

SEQ ID NO: 56069 - protein, 852 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLKKQLADERSNRDELELELAENRKLLTEKDAQIAMMQQRIDRLALLNEKQAASPLEPKELEELRDKNESLTMRLHETLKQCQDLKTEKSQMDRKINQLSEENGDLSFKLREFASHLQQLQDALNELTEEHSKATQEWLEKQAQLEKELSAALQDKKCLEEKNEILQGKLSQLEEHLSQLQDNPPQEKGEVLGDVLQLETLKQEAATLAANNTQLQARVEMLETERGQQEAKLLAERGHFEEEKQQLSSLITDLQSSISNLSQAKEELEQASQAHGARLTAQVASLTSELTTLNATIQQQDQELAGLKQQAKEKQAQLAQTLQQQEQASQGLRHQVEQLSSSLKQKEQQLKEVAEKQEATRQDHAQQLATAAEEREASLRERDAALKQLEALEKEKAAKLEILQQQLQVANEARDSAQTSVTQAQREKAELSRKVEELQACVETARQEQHEAQAQVAELELQLRSEQQKATEKERVAQEKDQLQEQLQALKESLKVTKGSLEEEKRRAADALEEQQRCISELKAETRSLVEQHKRERKELEEERAGRKGLEARLQQLGEAHQAETEVLRRELAEAMAAQHTAESECEQLVKEVAAWRERYEDSQQEEAQYGAMFQEQLMTLKEECEKARQELQEA

SEQ ID NO: 56070 - protein, 174 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQ

SEQ ID NO: 56071 - protein, 201 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSP

SEQ ID NO: 56072 - protein, 159 aa, Homo sapiens; identical to SEQ ID NO: 56066

SEQ ID NO: 56073 - protein, 220 aa, Homo sapiens
MTLHATRGAALLSWVNSLHVADPVEAVLQLQDCSIFIKIIDRIHGTEEGQQILKQPVSERLDFVCSFLQKNRKHPSSPECLVSAQKVLEGSELELAKMTMLLLYHSTMSSKSPRDWEQFEYKIQAELAVILKFVLDHEDGLNLNEDLENFLQKAPVPSTCSSTFPEELSPPSHQAKREIRFLELQKVASSSSGNNFLSGSPASPMGDILQTPQFQMRRLK

SEQ ID NO: 56074 - protein, 56 aa, Homo sapiens
MTLHATRGAALLSWVNSLHVADPVEAVLQLQDCSIFIKIIDRIHGTEEGQQILKQP

SEQ ID NO: 56075 - protein, 350 aa, Homo sapiens
MFCCLGYEWLSGGCKTWHSAWVINTLADHRHRGTDFGGSPWLLIITVFLRSYKFAISLCTSYLCVSFLKTIFPSQNGHDGSTDVQQRARRSNRRRQEGIKIVLEDIFTLWRQVETKVRAKIRKMKVTTKVNRHDKINGKRKTAKEHLRKLSMKEREHGEKERQVSEAEENGKLDMKEIHTYMEMFQRAQALRRRAEDYYRCKITPSARKPLCNRVRMAAVEHRHSSGLPYWPYLTAETLKNRMGHQPPPPTQQHSIIDNSLSLKTPSECLLTPLPPSALPSADDNLKTPAECLLYPLPPSADDNLKTPPECLLTPLPPSAPPSVDDNLKTPPECVCSLPFHPQRMIISRN

SEQ ID NO: 56076 - protein, 350 aa, Homo sapiens; identical to SEQ ID NO: 56075

SEQ ID NO: 56077 - protein, 476 aa, Homo sapiens
MASPFSGALQLTDLDDFIGPSQECIKPVKVEKRAGSGVAKIRIEDDGSYFQINQDGGTRRLEKAKVSLNDCLACSGCITSAETVLITQQSHEELKKVLDANKMAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSPQQVMGSLVKDFFAQQQHLTPDKIYHVTVMPCYDKKLEASRPDFFNQEHQTRDVDCVLTTGEVFRLLEEEGVSLPDLEPAPLDSLCSGASAEEPTSHRGGGSGGYLEHVFRHAARELFGIHVAEVTYKPLRNKDFQEVTLEKEGQVLLHFAMAYGFRNIQNLVQRLKRGRCPYHYVEVMACPSGCLNGGGQLQAPDRPSRELLQHVERLYGMVRAEAPEDAPGVQELYTHWLQGTDSECAGRLLHTQYHAVEKASTGLGIRW

SEQ ID NO: 56078 - protein, 188 aa, Homo sapiens
MASPFSGALQLTDLDDFIGPSQECIKPVKVEKRAGSGVAKIRIEDDGSYFQINQDGGTRRLEKAKVSLNDCLACSGCITSAETVLITQQSHEELKKVLDANKGCTSSSTPPSQGTSASWRASESLCGDSEDRPTADRRCPCWPLPAQAGSAMPRRLTAASSSPTSAPPGPRSRSWAPWSRTSSPSSST

SEQ ID NO: 56079 - protein, 374 aa, Homo sapiens
MAAPSQQRLVVVSVSPQSRASLAARFQLNPTDTARKLTSFFKKIGVHFVFDTAFSRHFSLLESQREFVRRFRGQADCRQALPLLASACPGWICYAEKTHGSFILPHISTARSPQQVMGSLVKDFFAQQQHLTPDKIYHVTVMPCYDKKLEASRPDFFNQEHQTRDVDCVLTTGEVFRLLEEEGVSLPDLEPAPLDSLCSGASAEEPTSHRGGGSGGYLEHVFRHAARELFGIHVAEVTYKPLRNKDFQEVTLEKEGQVLLHFAMAYGFRNIQNLVQRLKRGRCPYHYVEVMACPSGCLNGGGQLQAPDRPSRELLQHVERLYGMVRAEAPEDAPGVQELYTHWLQGTDSECAGRLLHTQYHAVEKASTGLGIRW

SEQ ID NO: 56080 - protein, 1427 aa, Homo sapiens
MLLPSDVARLVLGYLQQENLISTCQTFILESSDLKEYAEHCTDEGFIPACLLSLFGKNLTTILNEYVAMKTKETSNNVPAIMSSLWKKLDHTLSQIRSMQSSPRFAGSQRARTRTGIAEIKRQRKLASQTAPASAELLTLPYLSGQFTTPPSTGTQVTRPSGQISDPSRSYFVVVNHSQSQDTVTTGEALNVIPGAQEKKAHASLMSPGRRKSESQRKSTTLSGPHSTIRNFQDPNAFAVEKQMVIENAREKILSNKSLQEKLAENINKFLTSDNNIAQVPKQTDNNPTEPETSIDEFLGLPSEIHMSEEAIQDILEQTESDPAFQALFDLFDYGKTKNNKNISQSISSQPMESNPSIVLADETNLAVKGSFETEESDGQSGQPAFCTSYQNDDPLNALKNSNNHDVLRQEDQENFSQISTSIQKKAFKTAVPTEQKCDIDITFESVPNLNDFNQRGNSNAECNPHCAELYTNQMSTETEMAIGIEKNSLSSNVPSESQLQPDQPDIPITSFVSLGCEANNENLILSGKSSQLLSQDTSLTGKPSKKSQFCENSNDTVKLKINFHGSKSSDSSEVHKSKIEINVLEPVMSQLSNCQDNSCLQSEILPVSVESSHLNVSGQVEIHLGDSLSSTKQPSNDSASVELNHTENEAQASKSENSQEPSSSVKEENTIFLSLGGNANCEKVALTPPEGTPVENSHSLPPESVCSSVGDSHPESQNTDDKPSSNNSAEIDASNIVSLKVIISDDPFVSSDTELTSAVSSINGENLPTIILSSPTKSPTKNAELVKCLSSEETVGAVVYAEVGDSASMEQSLLTFKSEDSAVNNTQNEDGIAFSANVTPCVSKDGGYIQLMPATSTAFGNSNNILIATCVTDPTALGTSVSQSNVVVLPGNSAPMTAQPLPPQLQTPPRSNSVFAVNQAVSPNFSQGSAIIIASPVQPVLQGMVGMIPVSVVGQNGNNFSTPPRQVLHMPLTAPVCNRSIPQFPVPPKSQKAQGLRNKPCIGKQVNNLVDSSGHSVGCHAQKTEVSDKSIATDLGKKSEETTVPFPEESIVPAAKPCHRRVLCFDSTTAPVANTQGPNHKMVSQNKERNAVSFPNLDSPNVSSTLKPPSNNAIKREKEKPPLPKILSKSESAISRHTTIRETQSEKKVSPTEIVLESFHKATANKENELCSDVERQKNPENSKLSIGQQNGGLRSEKSIASLQEMTKKQGTSSNNKNVLSVGTAVKDLKQEQTKSASSLITTEMLQDIQRHSSVSRLADSSDLPVPRTPGSGAGEKHKEEPIDIIKAPSSRRFSEDSSTSKVMVPPVTPDLPACSPASETGSENSVNMAAHTLMILSRAAISRTTSATPLKDNTQQFRASSRSTTKKRKIEELDERERNSRPSSKNLTNSSIPMKKKKIKKKKLPSSFPAGMDVDKFLLSLHYDE

SEQ ID NO: 56081 - protein, 2427 aa, Homo sapiens
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 56082 - protein, 2427 aa, Homo sapiens; identical to SEQ ID NO: 56081

SEQ ID NO: 56083 - protein, 563 aa, Homo sapiens
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKTPP

SEQ ID NO: 56084 - protein, 2593 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 56085 - protein, 2696 aa, Homo sapiens
MDQTCELPRRNCLLPFSNPVNLDAPEDKDSPFGNGQSNFSEPLNGCTMQLSTVSGTSQNAYGQDSPSCYIPLRRLQDLASMINVEYLNGSADGSESFQDPEKSDSRAQTPIVCTSLSPGGPTALAMKQEPSCNNSPELQVKVTKTIKNGFLHFENFTCVDDADVDSEMDPEQPVTEDESIEEIFEETQTNATCNYETKSENGVKVAMGSEQDSTPESRHGAVKSPFLPLAPQTETQKNKQRNEVDGSNEKAALLPAPFSLGDTNITIEEQLNSINLSFQDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDERRGKIPENLGLNFISGDISDTQASNELSRIANSLTGSNTAPGSFLFSSCGKNTAKKEFETSNGDSLLGLPEGALISKCSREKNKPQRSLVCGSKVKLCYIGAGDEEKRSDSISICTTSDDGSSDLDPIEHSSESDNSVLEIPDAFDRTENMLSMQKNEKIKYSRFAATNTRVKAKQKPLISNSHTDHLMGCTKSAEPGTETSQVNLSDLKASTLVHKPQSDFTNDALSPKFNLSSSISSENSLIKGGAANQALLHSKSKQPKFRSIKCKHKENPVMAEPPVINEECSLKCCSSDTKGSPLASISKSGKVDGLKLLNNMHEKTRDSSDIETAVVKHVLSELKELSYRSLGEDVSDSGTSKPSKPLLFSSASSQNHIPIEPDYKFSTLLMMLKDMHDSKTKEQRLMTAQNLVSYRSPGRGDCSTNSPVGVSKVLVSGGSTHNSEKKGDGTQNSANPSPSGGDSALSGELSASLPGLLSDKRDLPASGKSRSDCVTRRNCGRSKPSSKLRDAFSAQMVKNTVNRKALKTERKRKLNQLPSVTLDAVLQGDRERGGSLRGGAEDPSKEDPLQIMGHLTSEDGDHFSDVHFDSKVKQSDPGKISEKGLSFENGKGPELDSVMNSENDELNGVNQVVPKKRWQRLNQRRTKPRKRMNRFKEKENSECAFRVLLPSDPVQEGRDEFPEHRTPSASILEEPLTEQNHADCLDSAGPRLNVCDKSSASIGDMEKEPGIPSLTPQAELPEPAVRSEKKRLRKPSKWLLEYTEEYDQIFAPKKKQKKVQEQVHKVSSRCEEESLLARGRSSAQNKQVDENSLISTKEEPPVLEREAPFLEGPLAQSELGGGHAELPQLTLSVPVAPEVSPRPALESEELLVKTPGNYESKRQRKPTKKLLESNDLDPGFMPKKGDLGLSKKCYEAGHLENGITESCATSYSKDFGGGTTKIFDKPRKRKRQRHAAAKMQCKKVKNDDSSKEIPGSEGELMPHRTATSPKETVEEGVEHDPGMPASKKMQGERGGGAALKENVCQNCEKLGELLLCEAQCCGAFHLECLGLTEMPRGKFICNECRTGIHTCFVCKQSGEDVKRCLLPLCGKFYHEECVQKYPPTVMQNKGFRCSLHICITCHAANPANVSASKGRLMRCVRCPVAYHANDFCLAAGSKILASNSIICPNHFTPRRGCRNHEHVNVSWCFVCSEGGSLLCCDSCPAAFHRECLNIDIPEGNWYCNDCKAGKKPHYREIVWVKVGRYRWWPAEICHPRAVPSNIDKMRHDVGEFPVLFFGSNDYLWTHQARVFPYMEGDVSSKDKMGKGVDGTYKKALQEAAARFEELKAQKELRQLQEDRKNDKKPPPYKHIKVNRPIGRVQIFTADLSEIPRCNCKATDENPCGIDSECINRMLLYECHPTVCPAGGRCQNQCFSKRQYPEVEIFRTLQRGWGLRTKTDIKKGEFVNEYVGELIDEEECRARIRYAQEHDITNFYMLTLDKDRIIDAGPKGNYARFMNHCCQPNCETQKWSVNGDTRVGLFALSDIKAGTELTFNYNLECLGNGKTVCKCGAPNCSGFLGVRPKNQPIATEEKSKKFKKKQQGKRRTQGEITKEREDECFSCGDAGQLVSCKKPGCPKVYHADCLNLTKRPAGKWECPWHQCDICGKEAASFCEMCPSSFCKQHREGMLFISKLDGRLSCTEHDPCGPNPLEPGEIREYVPPPVPLPPGPSTHLAEQSTGMAAQAPKMSDKPPADTNQMLSLSKKALAGTCQRPLLPERPLERTDSRPQPLDKVRDLAGSGTKSQSLVSSQRPLDRPPAVAGPRPQLSDKPSPVTSPSSSPSVRSQPLERPLGTADPRLDKSIGAASPRPQSLEKTSVPTGLRLPPPDRLLITSSPKPQTSDRPTDKPHASLSQRLPPPEKVLSAVVQTLVAKEKALRPVDQNTQSKNRAALVMDLIDLTPRQKERAASPHQVTPQADEKMPVLESSSWPASKGLGHMPRAVEKGCVSDPLQTSGKAAAPSEDPWQAVKSLTQARLLSQPPAKAFLYEPTTQASGRASAGAEQTPGPLSQSPGLVKQAKQMVGGQQLPALAAKSGQSFRSLGKAPASLPTEEKKLVTTEQSPWALGKASSRAGLWPIVAGQTLAQSCWSAGSTQTLAQTCWSLGRGQDPKPEQNTLPALNQAPSSHKCAESEQK

SEQ ID NO: 56086 - protein, 155 aa, Homo sapiens
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEAS

SEQ ID NO: 56087 - protein, 124 aa, Homo sapiens
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFE

SEQ ID NO: 56088 - protein, 1399 aa, Homo sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQDKKTEEFFSVVTTD

SEQ ID NO: 56089 - protein, 1441 aa, Homo sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQQVQQVQVFADVQCTVNLVGGDPYLNQPGPLGTQKPTSGPQTPQAQQKSLLQQLLTE

SEQ ID NO: 56090 - protein, 1440 aa, Homo sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPAITGVESFMTKQDTTGKIISIDTSSLRAAGRTGWEDLVRKCIYAFFQPQGREPSYARQLFQEVMTRGTASSPSYRFILNDGTMLSAHTKCKLCYPQSPDMQPFIMGIHIIDREHSGLSPQDDTNSGMSIPRVNPSVNPSISPAHGVARSSTLPPSNSNMVSTRINRQQSSDLHSSSHSNSSNSQGSFGCSPGSQIVANVALNQGQASSQSSNPSLNLNNSPMEGTGISLAQFMSPRRQVTSGLATRPRMPNNSFPPNISTLSSPVGMTSSACNNNNRSYSNIPVTSLQGMNEGPNNSVGFSASSPVLRQMSSQNSPSRLNIQPAKAESKDNKEIASILNEMIQSDNSSSDGKPLDSGLLHNNDRLSDGDSKYSQTSHKLVQLLTTTAEQQLRHADIDTSCKDVLSCTGTSNSASANSSGGSCPSSHSSLTERHKILHRLLQEGSPSDITTLSVEPDKKDSASTSVSVTGQVQGNSSIKLELDASKKKESKDHQLLRYLLDKDEKDLRSTPNLSLDDVKVKVEKKEQMDPCNTNPTPMTKPTPEEIKLEAQSQFTADLDQFDQLLPTLEKAAQLPGLCETDRMDGAVTSVTIKSEILPASLQSATARPTSRLNRLPELELEAIDNQFGQPGTGDQIPWTNNTVTAINQSKSEDQCISSQLDELLCPPTTVEGRNDEKALLEQLVSFLSGKDETELAELDRALGIDKLVQGGGLDVLSERFPPQQATPPLIMEERPNLYSQPYSSPSPTANLPSPFQGMVRQKPSLGTMPVQVTPPRGAFSPGMGMQPRQTLNRPPAAPNQLRLQLQQRLQGQQQLIHQNRQAILNQFAATAPVGINMRSGMQQQITPQPPLNAQMLAQRQRELYSQQHRQRQLIQQQRAMLMRQQSFGNNLPPSSGLPVQMGNPRLPQGAPQQFPYPPNYGTNPGTPPASTSPFSQLAANPEASLANRNSMVSRGMTGNIGGQFGTGINPQMQQNVFQYPGAGMVPQGEANFAPSLSPGSSMVPMPIPPPQSSLLQQTPPASGYQSPDMKAWQQGAIGNNNVFSQAVQNQPTPAQPGVYNNMSITVSMAGGNTNVQNMNPMMAQMQMSSLQMPGMNTVCPEQINDPALRHTGLYCNQLSSTDLLKTEADGTQVQQVQVFADVQCTVNLVGGDPYLNQPGPLGTQKPTSGPQTPQAQQKSLLQQLLTE

SEQ ID NO: 56091 - protein, 1399 aa, Homo sapiens; identical to SEQ ID NO: 56088

SEQ ID NO: 56092 - protein, 1441 aa, Homo sapiens; identical to SEQ ID NO: 56089

SEQ ID NO: 56093 - protein, 1399 aa, Homo sapiens; identical to SEQ ID NO: 56088

SEQ ID NO: 56094 - protein, 552 aa, Homo sapiens
MQLTAENSPVTPVGAQKTALRISQSRMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 56095 - protein, 1464 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARRVPMKERPVLPSSESFTTRQDLQGKITSLDTSTMRAAMKPGWEDLVRRCIQKFHAQHEGESVSYAKRHHHEVLRQGLAFSQIYRFSLSDGTLVAAQTKSKLIRSQTTNEPQLVISLHMLHREQNVCVMNPDLTGQTMGKPLNPISSNSPAHQALCSGNPGQDMTLSSNINFPINGPKEQMGMPMGRFGGSGGMNHVSGMQATTPQGSNYALKMNSPSQSSPGMNPGQPTSMLSPRHRMSPGVAGSPRIPPSQFSPAGSLHSPVGVCSSTGNSHSYTNSSLNALQALSEGHGVSLGSSLASPDLKMGNLQNSPVNMNPPPLSKMGSLDSKDCFGLYGEPSEGTTGQAESSCHPGEQKETNDPNLPPAVSSERADGQSRLHDSKGQTKLLQLLTTKSDQMEPSPLASSLSDTNKDSTGSLPGSGSTHGTSLKEKHKILHRLLQDSSSPVDLAKLTAEATGKDLSQESSSTAPGSEVTIKQEPVSPKKKENALLRYLLDKDDTKDIGLPEITPKLERLDSKTDPASNTKLIAMKTEKEEMSFEPGDQPGSELDNLEEILDDLQNSQLPQLFPDTRPGAPAGSVDKQAIINDLMQLTAENSPVTPVGAQKTALRISQSTFNNPRPGQLGRLLPNQNLPLDITLQSPTGAGPFPPIRNSSPYSVIPQPGMMGNQGMIGNQGNLGNSSTGMIGNSASRPTMPSGEWAPQSSAVRVTCAATTSAMNRPVQGGMIRNPAASIPMRPSSQPGQRQTLQSQVMNIGPSELEMNMGGPQYSQQQAPPNQTAPWPESILPIDQASFASQNRQPFGSSPDDLLCPHPAAESPSDEGALLDQLYLALRNFDGLEEIDRALGIPELVSQSQAVDPEQFSSQDSNIMLEQKAPVFPQQYASQAQMAQGSYSPMQDPNFHTMGQRPSYATLRMQPRPGLRPTGLVQNQPNQLRLQLQHRLQAQQNRQPLMNQISNVSNVNLTLRPGVPTQAPINAQMLAQRQREILNQHLRQRQMHQQQQVQQRTLMMRGQGLNMTPSMVAPSGMPATMSNPRIPQANAQQFPFPPNYGISQQPDPGFTGATTPQSPLMSPRMAHTQSPMMQQSQANPAYQAPSDINGWAQGNMGGNSMFSQQSPPHFGQQANTSMYSNNMNINVSMATNTGGMSSMNQMTGQISMTSVTSVPTSGLSSMGPEQVNDPALRGGNLFPNQLPGMDMIKQEGDTTRKYC

SEQ ID NO: 56096 - protein, 16 aa, Homo sapiens
MSGMGENTSDPSRAET

SEQ ID NO: 56097 - protein, 8 aa, Homo sapiens
MSGMGENT

SEQ ID NO: 56098 - protein, 1420 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 56099 - protein, 1350 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEVTSDGIFSPTAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 56100 - protein, 1415 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEVTSDGIFSPTAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 56101 - protein, 1424 aa, Homo sapiens
MSGLGENLDPLASDSRKRKLPCDTPGQGLTCSGEKRRREQESKYIEELAELISANLSDIDNFNVKPDKCAILKETVRQIRQIKEQGKTISNDDDVQKADVSSTGQGVIDKDSLGPLLLQALDGFLFVVNRDGNIVFVSENVTQYLQYKQEDLVNTSVYNILHEEDRKDFLKNLPKSTVNGVSWTNETQRQKSHTFNCRMLMKTPHDILEDINASPEMRQRYETMQCFALSQPRAMMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMISPRNRGSPKIASHQFSPVAGVHSPMASSGNTGNHSFSSSSLSALQAISEGVGTSLLSTLSSPGPKLDNSPNMNITQPSKVSNQDSKSPLGFYCDQNPVESSMCQSNSRDHLSDKESKESSVEGAENQRGPLESKGHKKLLQLLTCSSDDRGHSSLTNSPLDSSCKESSVSVTSPSGVSSSTSGGVSSTSNMHGSLLQEKHRILHKLLQNGNSPAEVAKITAEATGKDTSSITSCGDGNVVKQEQLSPKKKENNALLRYLLDRDDPSDALSKELQPQVEGVDNKMSQCTSSTIPSSSQEKDPKIKTETSEEGSGDLDNLDAILGDLTSSDFYNNSISSNGSHLGTKQQVFQGTNSLGLKSSQSVQSIRPPYNRAVSLDSPVSVGSSPPVKNISAFPMLPKQPMLGGNPRMMDSQENYGSSMGGPNRNVTVTQTPSSGDWGLPNSKAGRMEPMNSNSMGRPGGDYNTSLPRPALGGSIPTLPLRSNSIPGARPVLQQQQQMLQMRPGEIPMGMGANPYGQAAASNQLGSWPDGMLSMEQVSHGTQNRPLLRNSLDDLVGPPSNLEGQSDERALLDQLHTLLSNTDATGLEEIDRALGIPELVNQGQALEPKQDAFQGQEAAVMMDQKAGLYGQTYPAQGPPMQGGFHLQGQSPSFNSMMNQMNQQGNFPLQGMHPRANIMRPRTNTPKQLRMQLQQRLQGQQFLNQSRQALELKMENPTAGGAAVMRPMMQPQVSSQQGFLNAQMVAQRSRELLSHHFRQQRVAMMMQQQQQQQQQQQQQQQQQQQQQQQQQQQQQTQAFSPPPNVTASPSMDGLLAGPTMPQAPPQQFPYQPNYGMGQQPDPAFGRVSSPPNAMMSSRMGPSQNPMMQHPQAASIYQSSEMKGWPSGNLARNSSFSQQQFAHQGNPAVYSMVHMNGSSGHMGQMNMNPMPMSGMPMGPDQKYC

SEQ ID NO: 56102 - protein, 1420 aa, Homo sapiens; identical to SEQ ID NO: 56098

SEQ ID NO: 56103 - protein, 257 aa, Homo sapiens
MMEEGEDLQSCMICVARRITTGERTFPSNPESFITRHDLSGKVVNIDTNSLRSSMRPGFEDIIRRCIQRFFSLNDGQSWSQKRHYQEAYLNGHAETPVYRFSLADGTIVTAQTKSKLFRNPVTNDRHGFVSTHFLQREQNGYRPNPNPVGQGIRPPMAGCNSSVGGMSMSPNQGLQMPSSRAYGLADPSTTGQMSGARYGGSSNIASLTPGPGMQSPSSYQNNNYGLNMSSPPHGSPGLAPNQQNIMILLVIVGVQR

SEQ ID NO: 56104 - protein, 287 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQQEVLLNSPLQEEHNFPPDHYGLPAVCDLFACMQLKVDKEKWLYRTPLQV

SEQ ID NO: 56105 - protein, 614 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 56106 - protein, 575 aa, Homo sapiens
MNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKYYLIHLYRRNITSPQTIMASLQFVISLPVCSLKLIKRSGYIELLYRCEGMDKS

SEQ ID NO: 56107 - protein, 614 aa, Homo sapiens; identical to SEQ ID NO: 56105

SEQ ID NO: 56108 - protein, 448 aa, Homo sapiens
MAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 56109 - protein, 514 aa, Homo sapiens
MNRWTLFISLKRRHFNSRLSSSTRLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 56110 - protein, 264 aa, Homo sapiens
  MOD_RES (1)..(1): Any amino acid
XCTPAWAAELDSVSKQKKNPKPTFKKKTEERTCEVKKVSRLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCT

SEQ ID NO: 56111 - protein, 630 aa, Homo sapiens
MGAQLTTFALAGAVRRMNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQM

SEQ ID NO: 56112 - protein, 614 aa, Homo sapiens; identical to SEQ ID NO: 56105

SEQ ID NO: 56113 - protein, 650 aa, Homo sapiens
MGAQLTTFALAGAVRRMNTFQDQSGSSSNREPLLRCSDARRDLELAIGGVLRAEQQIKDNLREVKAQIHSCISRHLECLRSREVWLYEQVDLIYQLKEETLQQQAQQLYSLLGQFNCLTHQLECTQNKDLANQVSVCLERLGSLTLKPEDSTVLLFEADTITLRQTITTFGSLKTIQIPEHLMAHASSANIGPFLEKRGCISMPEQKSASGIVAVPFSEWLLGSKPASGYQAPYIPSTDPQDWLTQKQTLENSQTSSRACNFFNNVGGNLKGLENWLLKSEKSSYQKCNSHSTTSSFSIEMEKVGDQELPDQDEMDLSDWLVTPQESHKLRKPENGSRETSEKFKLLFQSYNVNDWLVKTDSCTNCQGNQPKGVEIENLGNLKCLNDHLEAKKPLSTPSMVTEDWLVQNHQDPCKVEEVCRANEPCTSFAECVCDENCEKEALYKWLLKKEGKDKNGMPVEPKPEPEKHKDSLNMWLCPRKEVIEQTKAPKAMTPSRIADSFQVIKNSPLSEWLIRPPYKEGSPKEVPGTEDRAGKQKFKSPMNTSWCSFNTADWVLPGKKMGNLSQLSSGEDKWLLRKKAQEVLLNSPLQEEHNFPPDHYGLPAVCDLFACMQLKVDKEKWLYRTPLQAYFKMNFQDVTVGNFQIPCGF

SEQ ID NO: 56114 - protein, 2063 aa, Homo sapiens
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPGIIRMNNPATVMIPPGGNVSSSMMAPGPNPELQPRTPRPASQSDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQMKSLQGGPSRVPTPLQQPHLTNKSPASSPSSFQQGSPASSPTVNQTQQQMGPRPPQNNPLPQGFQQPVSSPGRNPMVQQGNVPPNFMVMQQQPPNQGPQSLHPGLGGMPKRLPPGFSAGQANPNFMQGQVPSTTATTPGNSGAPQLQANQNVQHAGGQGAGPPQNQMQVSHGPPNMMQPSLMGIHGNMNNQQAGTSGVPQVNLSNMQGQPQQGPPSQLMGMHQQIVPSQGQMVQQQGTLNPQNPMILSRAQLMPQGQMMVNPPSQNLGPSPQRMTPPKQMLSQQGPQMMAPHNQMMGPQGQVLLQQNPMIEQIMTNQMQGNKQQFNTQNQSNVMPGPAQIMRGPTPNMQGNMVQFTGQMSGQMLPQQGPVNNSPSQVMGIQGQVLRPPGPSPHMAQQHGDPATTANNDVSLSQMMPDVSIQQTNMVPPHVQAMQGNSASGNHFSGHGMSFNAPFSGAPNGNQMSCGQNPGFPVNKDVTLTSPLLVNLLQSDISAGHFGVNNKQNNTNANKPKKKKPPRKKKNSQQDLNTPDTRPAGLEEADQPPLPGEQGINLDNSGPKLPEFSNRPPGYPSQPVEQRPLQQMPPQLMQHVAPPPQPPQQQPQPQLPQQQQPPPPSQPQSQQQQQQQQQMMMMLMMQQDPKSVRLPVSQNVHPPRGPLNPDSQRMPMQQSGSVPVMVSLQGPASVPPSPDKQRMPMPVNTPLGSNSRKMVYQESPQNPSSSPLAEMASLPEASGSEAPSVPGGPNNMPSHVVLPQNQLMMTGPKPGPSPLSATQGATPQQPPVNSLPSSHGHHFPNVAAPTQTSRPKTPNRASPRPYYPQTPNNRPPSTEPSEISLSPERLNASIAGLFPPQINIPLPPRPNLNRGFDQQGLNPTTLKAIGQAPSNLTMNPSNFATPQTHKLDSVVVNSGKQSNSGATKRASPSNSRRSSPGSSRKTTPSPGRQNSKAPKLTLASQTNAALLQNVELPRNVLVSPTPLANPPVPGSFPNNSGLNPQNSTVSVAAVGGVVEDNKESLNVPQDSDCQNSQSRKEQVNIELKAVPAQEVKMVVPEDQSKKDGQPSDPNKLPSVEENKNLVSPAMREAPTSLSQLLDNSGAPNVTIKPPGLTDLEVTPPVVSGEDLKKASVIPTLQDLSSSKEPSNSLNLPHSNELCSSLVHPELSEVSSNVAPSIPPVMSRPVSSSSISTPLPPNQITVFVTSNPITTSANTSAALPTHLQSALMSTVVTMPNAGSKVMVSEGQSAAQSNARPQFITPVFINSSSIIQVMKGSQPSTIPAAPLTTNSGLMPPSVAVVGPLHIPQNIKFSSAPVPPNALSSSPAPNIQTGRPLVLSSRATPVQLPSPPCTSSPVVPSHPPVQQVKELNPDEASPQVNTSADQNTLPSSQSTTMVSPLLTNSPGSSGNRRSPVSSSKGKGKVDKIGQILLTKACKKVTGSLEKGEEQYGADGETEGQGLDTTAPGLMGTEQLSTELDSKTPTPPAPTLLKMTSSPVGPGTASAGPSLPGGALPTSVRSIVTTLVPSELISAVPTTKSNHGGIASESLAGGLVEEKVGSHPELLPSIAPSQNLVSKETSTTALQASVARPELEVNAAIVSGQSSEPKEIVEKSKIPGRRNSRTEEPTVASESVENGHRKRSSRPASASSSTKDITSAVQSKRRKSK

SEQ ID NO: 56115 - protein, 2063 aa, Homo sapiens; identical to SEQ ID NO: 56114

SEQ ID NO: 56116 - protein, 361 aa, Homo sapiens
MVLDDLPNLEDIYTSLCSSTMEDSEMDFDSGLEDDDTKSDSILEDSTIFVAFKGNIDDKDFKWKLDAILKNVPNLLHMESSKLKVQKVEPWNSVRVTFNIPREAAERLRILAQSNNQQLRDLGILSVQIEGEGAINLALAQNRSQDVRMNGPMGAGNSVRMEAGFPMASGPDAMDPLLSGLHIQQQSHPSGSLAPPHHPMQPVSVNRQMNPANFPQLQQQQQQQQQQQQQQQQQQQQQQQQQLQARPPQQHQQQQPQGIRPQFTAPTQVPVPPGWNQLPSGALQPPPAQGSLGTMTANQGWKKAPLPGPMQQQLQARPSLATVQTPSHPPPPYPFGSQQASQAHTNFPQMSNPGQFTAPQM

SEQ ID NO: 56117 - protein, 827 aa, Homo sapiens
MVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRERVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 56118 - protein, 183 aa, Homo sapiens
MGAAHSVWEVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFK

SEQ ID NO: 56119 - protein, 942 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLPDADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSDLPQDLCPLYRPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIEDILPSKEEKSKTPPMFLCIKVGKPMRKSFATHTAAMVQQYGKRRKQPEYWFAVPRERVDHLYTFFVQWSPDVYGKDAKEQGFVVVEKEELNMIDNFFSEPTTKSWEIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 56120 - protein, 942 aa, Homo sapiens; identical to SEQ ID NO: 56119

SEQ ID NO: 56121 - protein, 440 aa, Homo sapiens
DADLARKALKPIERVLSSTSEEDEPGVVKFLKMNCRYFTDGKGVVGGVMIVTPNNIMFDPHKSDPLVIENGCEEYGLICPMEEVVSIALYNDISHMKIKDALPSPGEWEDLASEKDINPFSKFKSINKEKRQQNGEKIMTSDSRPIVPLEKSTGHTPTKPSGSSVSEKLKKLDSSRETSHGSPTVTKLSKEPSDTSSAFESTAKENFLGEDDDFVDLEELSSQTGGGMHKKDTLKECLSLDPEERKKAESQINNSAVEMQVQSALAFLGTENDVELKGALDLETCEKQDIMPEVDKQSGSPESRVENTLNIHEDLDKVKLIEYYLTKNKEGPQVSENLQKTELSDGKSIEPGGIDITLSSSLSQAGDPITEGNKEPDKTWVKKGEPLPVKLNSSTEANVIKEALDSSLESTLDNSCQGAQMDNKSEVQLWLLKRIQVPIE

SEQ ID NO: 56122 - protein, 191 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYTAGNQDTLNSIALKFNITPNKLVELNKLFTHTIVPGQVLFVPDANSPSSTLRLSSSSPGATVSPSSSDAEYDKLP

SEQ ID NO: 56123 - protein, 117 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSIDDNQNKTHDKKEKKMVVQKPHGTMEYT

SEQ ID NO: 56124 - protein, 90 aa, Homo sapiens
MDTKEEKKERKQSYFARLKKKKQAKQNAETASAVATRTHTGKEDNNTVVLEPDKCNIAVEEEYMTDEKKKRKSNQLKEIRRTELKRYYSI

SEQ ID NO: 56125 - protein, 90 aa, Homo sapiens; identical to SEQ ID NO: 56124

SEQ ID NO: 56126 - protein, 183 aa, Homo sapiens; identical to SEQ ID NO: 56118

SEQ ID NO: 56127 - protein, 237 aa, Homo sapiens
  MOD_RES (1)..(1): Any amino acid
XEKTCSSLEREPHFSLLTMRGQRLPLDIQIFYCARPDEEPFVKIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKVFKWSGENSYFINGDISSLELGGGGGRFGLWLDADLYHGRSNSCSTFNNDILSKKEDFIVQDLEVWAFD

SEQ ID NO: 56128 - protein, 177 aa, Homo sapiens
  MOD_RES (1)..(1): Any amino acid
XEKTCSSLEREPHFSLLTMRGQRLPLDIQIFYCARPDEEPFVKIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKGTIWFMARC

SEQ ID NO: 56129 - protein, 190 aa, Homo sapiens
  MOD_RES (1)..(1): Any amino acid
XEKTCSSLEREPHFSLLTMRGQRLPLDIQIFYCARPDEEPFVKIITVEEAKRRKSTCSYYEDEDEEVLPVLRPHSALLENMHIEQLARRLPARVQGYPWRLAYSTLEHGTSLKTLYRKSASLDSPVLLVIKDMDNQIFGAYATHPFKFSDHYYGTGETFLYTFSPHFKWSGENSYFINGDISSLELGGGG

SEQ ID NO: 56130 - protein, 90 aa, Homo sapiens; identical to SEQ ID NO: 56124

SEQ ID NO: 56131 - protein, 2521 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 56132 - protein, 2459 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 56133 - protein, 2075 aa, Homo sapiens
MWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 56134 - protein, 2458 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 56135 - protein, 2514 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 56136 - protein, 2504 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEATVNNSSDTESIPSPHTEAAKDTGQNGPKPPATLGADGPPPGPPTPPPEDIPAPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAEKPVFFPAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 56137 - protein, 2513 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELPLYNQPSDTRQYHENIKINQAMRKKLILYFKRRNHARKQWEQKFCQRYDQLMEAWEKKVERIENNPRRRAKESKVREYYEKQFPEIRKQRELQERMQSRVGQRGSGLSMSAARSEHEVSEIIDGLSEQENLEKQMRQLAVIPPMLYDADQQRIKFINMNGLMADPMKVYKDRQVMNMWSEQEKETFREKFMQHPKNFGLIASFLERKTVAECVLYYYLTKKNENYKSLVRRSYRRRGKSQQQQQQQQQQQQQQQQQPMPRSSQEEKDEKEKEKEAEKEEEKPEVENDKEDLLKEKTDDTSGEDNDEKEAVASKGRKTANSQGRRKGRITRSMANEANSEEAITPQQSAELASMELNESSRWTEEEMETAKKGLLEHGRNWSAIARMVGSKTVSQCKNFYFNYKKRQNLDEILQQHKLKMEKERNARRKKKKAPAAASEEAAFPPVVEDEEMEASGVSGNEEEMVEEAEALHASGNEVPRGECSGPATVNNSSDTESIPSPHTEAAKDTGQNGPKPPATLGADGPPPGPPTPPRRTSRPTEPTPASEATGAPTPPPAPPSPSAPPPVVPKEEKEEETAAAPPVEEGEEQKPPAAEELAVDTGKAEEPVKSECTEEAEEGPAKGKDAEAAEATAEGALKAEKKEGGSGRATTAKSSGAPQDSDSSATCSADEVDEAEGGDKNRLLSPRPSLLTPTGDPRANASPQKPLDLKQLKQRAAAIPPIQVTKVHEPPREDAAPTKPAPPAPPPPQNLQPESDAPQQPGSSPRGKSRSPAPPADKEAFAAEAQKLPGDPPCWTSGLPFPVPPREVIKASPHAPDPSAFSYAPPGHPLPLGLHDTARPVLPRPPTISNPPPLISSAKHPSVLERQIGAISQGMSVQLHVPYSEHAKAPVGPVTMGLPLPMDPKKLAPFSGVKQEQLSPRGQAGPPESLGVPTAQEASVLRGTALGSVPGGSITKGIPSTRVPSDSAITYRGSITHGTPADVLYKGTITRIIGEDSPSRLDRGREDSLPKGHVIYEGKKGHVLSYEGGMSVTQCSKEDGRSSSGPPHETAAPKRTYDMMEGRVGRAISSASIEGLMGRAIPPERHSPHHLKEQHHIRGSITQGIPRSYVEAQEDYLRREAKLLKREGTPPPPPPSRDLTEAYKTQALGPLKLKPAHEGLVATVKEAGRSIHEIPREELRHTPELPLAPRPLKEGSITQGTPLKYDTGASTTGSKKHDVRSLIGSPGRTFPPVHPLDVMADARALERACYEESLKSRPGTASSSGGSIARGAPVIVPELGKPRQSPLTYEDHGAPFAGHLPRGSPVTTREPTPRLQEGSLSSSKASQDRKLTSTPREIAKSPHSTVPEHHPHPISPYEHLLRGVSGVDLYRSHIPLAFDPTSIPRGIPLDAAAAYYLPRHLAPNPTYPHLYPPYLIRGYPDTAALENRQTIINDYITSQQMHHNAATAMAQRADMLRGLSPRESSLALNYAAGPRGIIDLSQVPHLPVLVPPTPGTPATAMDRLAYLPTAPQPFSSRHSSSPLSPGGPTHLTKPTTTSSSERERDRDRERDRDREREKSILTSTTTVEHAPIWRPGTEQSSGSSGGGGGSSSRPASHSHAHQHSPISPRTQDALQQRPSVLHNTGMKGIITAVEPSTPTVLRSTSTSSPVRPAATFPPATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 56138 - protein, 606 aa, Homo sapiens
LQSGATHCPLGGTLDGVYPTLMEPVLLPKEAPRVARPERPRADTGHAFLAKPPARSGLEPASSPSKGSEPRPLVPPVSGHATIARTPAKNLAPHHASPDPPAPPASASDPHREKTQSKPFSIQELELRSLGYHGSSYSPEGVEPVSPVSSPSLTHDKGLPKHLEELDKSHLEGELRPKQPGPVKLGGEAAHLPHLRPLPESQPSSSPLLQTAPGVKGHQRVVTLAQHISEVITQDYTRHHPQQLSAPLPAPLYSFPGASCPVLDLRRPPSDLYLPPPDHGAPARGSPHSEGGKRSPEPNKTSVLGGGEDGIEPVSPPEGMTEPGHSRSAVYPLLYRDGEQTEPSRMGSKSPGNTSQPPAFFSKLTESNSAMVKSKKQEINKKLNTHNRNEPEYNISQPGTEIFNMPAITGTGLMTYRSQAVQEHASTNMGLEAIIRKALMGKYDQWEESPPLSANAFNPLNASASLPAAMPITAADGRSDHTLTSPGGGGKAKVSGRPSSRKAKSPAPGLASGDRPPSVSSVHSEGDCNRRTPLTNRVWEDRPSSAGSTPFPYNPLIMRLQAGVMASPPPPGLPAGSGPLAGPHHAWDEEPKPLLCSQYETLSDSE

SEQ ID NO: 56139 - protein, 241 aa, Homo sapiens
MFYSGLLTEGGRKETDMREAASLRQQRRMKQAVQFIHKDSADLLPLDGLKKLGSSKDMQPHNILQRRLMETNLSKLRSGPRVPWASKTNKLNQAKSEGLKKSEEDDMILVSCQCAGKDVKALVDTGCLYNLISLACVDRLGLKEHVKSHKHEGEKLSLPRHLKVVGQIEHLVITLGSLRLDCPAAVVDDNEKNLSLGLQTLRSLKCIINLDKHRLIMGKTDKEEIPFVETVSLNEDNTSEA

SEQ ID NO: 56140 - protein, 257 aa, Homo sapiens
MSTSQPGACPCQGAASRPAILYALLSSSLKAVPRPRSRCLCRQHRPVQLCAPHRTCREALDVLAKTVAFLRNLPSFWQLPPQDQRRLLQGCWGPLFLLGLAQDAVTFEVAEAPVPSILKKILLEEPSSSGGSGQLPDRPQPSLAAVQWLQCCLESFWSLELSPKEYACLKGTILFNPDVPGLQAASHIGHLQQEAHWVLCEVLEPWCPAAQGRLTRVLLTASTLKSIPTSLLGDLFFRPIIGDVDIAGLLGDMLLLR

SEQ ID NO: 56141 - protein, 614 aa, Homo sapiens
MTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKGFFRRSIQQNIQYKRCLKNENCSIVRINRNRCQQCRFKKCLSVGMSRDAVRFGRIPKREKQRMLAEMQSAMNLANNQLSSQCPLETSPTQHPTPGPMGPSPPPAPVPSPLVGFSQFPQQLTPPRSPSPEPTVEDVISQVARAHREIFTYAHDKLGSSPGNFNANHASGSPPATTPHRWENQGCPPAPNDNNTLAAQRHNEALNGLRQAPSSYPPTWPPGPAHHSCHQSNSNGHRLCPTHVYAAPEGKAPANSPRQGNSKNVLLACPMNMYPHGRSGRTVQEIWEDFSMSFTPAVREVVEFAKHIPGFRDLSQHDQVTLLKAGTFEVLMVRFASLFNVKDQTVMFLSRTTYSLQELGAMGMGDLLSAMFDFSEKLNSLALTEEELGLFTAVVLVSADRSGMENSASVEQLQETLLRALRALVLKNRPLETSRFTKLLLKLPDLRTLNNMHSEKLLSFRVDAQ

SEQ ID NO: 56142 - protein, 460 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 56143 - protein, 458 aa, Homo sapiens
MSSPTTSSLDTPLPGNGPPQPGAPSSSPTVKEEGPEPWPGGPDPDVPGTDEASSACSTDWVIPDPEEEPERKRKKGPAPKMLGHELCRVCGDKASGFHYNVLSCEGCKGFFRRSVVRGGARRYACRGGGTCQMDAFMRRKCQQCRLRKCKEAGMREQCVLSEEQIRKKKIRKQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNGAGPRGGVAAALRGGAAVLHAHQEAADQLRFPRMLMKLVSLRTLSSVHSEQVFALRLQDKKLPPLLSEIWDVHE

SEQ ID NO: 56144 - protein, 363 aa, Homo sapiens
MSSPTTSSLDTPLPGNGPPQPGAPSSSPTVKEEGPEPWPGGPDPDVPGTDEASSACSTDWGVLSEEQIRKKKIRKQQQESQSQSQSPVGPQGSSSSASGPGASPGGSEAGSQGSGEGEGVQLTAAQELMIQQLVAAQLQCNKRSFSDQPKVTPWPLGADPQSRDARQQRFAHFTELAIISVQEIVDFAKQVPGFLQLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 56145 - protein, 191 aa, Homo sapiens
MIQQLVAAQLQCNKRSFSDQPKVTLGREDQIALLKASTIEIMLLETARRYNHETECITFLKDFTYSKDDFHRAGLQVEFINPIFEFSRAMRRLGLDDAEYALLIAINIFSADRPNVQEPGRVEALQQPYVEALLSYTRIKRPQDQLRFPRMLMKLVSLRTLSSVHSEQVFALRLQDKKLPPLLSEIWDVHE

SEQ ID NO: 56146 - protein, 473 aa, Homo sapiens
MTVTRTHHFKEGSLRAPAIPLHSAAAELASNHPRGPEANLEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 56147 - protein, 434 aa, Homo sapiens
LEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRLPGVLSSGCELPESLQAPSREEAAKWSQVRKDLCSLKVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 56148 - protein, 397 aa, Homo sapiens
LEVRPKESWNHADFVHCEDTESVPGKPSVNADEEVGGPQICRVCGDKATGYHFNVMTCEGCKGFFRRAMKRNARLRCPFRKGACEITRKTRRQCQACRLRKCLESGMKKEMIMSDEAVEERRALIKRKKSERTGTQPLGVQGLTEEQRMMIRELMDAQMKTFDTTFSHFKNFRVSLQLRGEDGSVWNYKPPADSGGKEIFSLLPHMADMSTYMFKGIISFAKVISYFRDLPIEDQISLLKGAAFELCQLRFNTVFNAETGTWECGRLSYCLEDTAGGFQQLLLEPMLKFHYMLKKLQLHEEEYVLMQAISLFSPDRPGVLQHRVVDQLQEQFAITLKSYIECNRPQPAHRFLFLKIMAMLTELRSINAQHTQRLLRIQDIHPFATPLMQELFGITGS

SEQ ID NO: 56149 - protein, 615 aa, Homo sapiens
MTSPSPRIQIISTDSAVASPQRIQGSEPASGPLSVFTSLNKEKIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 56150 - protein, 596 aa, Homo sapiens
MTSPSPRIQIISTDSAVASPQRIQIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQTGLLDPGMLVNIQQPLIREDGTVLLATDSKAETSQGALGTLANVVTSLANLSESLNNGDTSEIQPEDQSASEITRAFDTLAKALNTTDSSSSPSLADGIDTSGGGSIHVISRDQSTPIIEVEGPLLSDTHVTFKLTMPSPMPEYLNVHYICESASRLLFLSMHWARSIPAFQALGQDCNTSLVRACWNELFTLGLAQCAQVMSLSTILAAIVNHLQNSIQEDKLSGDRIKQVMEHIWKLQEFCNSMAKLDIDGYEYAYLKAIVLFSPDHPGLTSTSQIEKFQEKAQMELQDYVQKTYSEDTYRLARILVRLPALRLMSSNITEELFFTGLIGNVSIDSIIPYILKMETAEYNGQITGASL

SEQ ID NO: 56151 - protein, 596 aa, Homo sapiens; identical to SEQ ID NO: 56150

SEQ ID NO: 56152 - protein, 596 aa, Homo sapiens; identical to SEQ ID NO: 56150

SEQ ID NO: 56153 - protein, 36 aa, Homo sapiens
MTSPSPRIQIISTDSAVASPQRIQGSEPASGPLSVF

SEQ ID NO: 56154 - protein, 205 aa, Homo sapiens
MTSPSPRIQIISTDSAVASPQRIQGSEPASGPLSVFTSLNKEKIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMEC

SEQ ID NO: 56155 - protein, 422 aa, Homo sapiens
MFRAGAEGAEKEPSPRPECRADPGPGLGFPLGSGLPWPSLLESPGGRILDIPCKVCGDRSSGKHYGVYACDGCSGFFKRSIRRNRTYVCKSGNQGGCPVDKTHRNQCRACRLKKCLEVNMNKDAVQHERGPRTSTIRKQVALYFRGHKEENGAAAHFPSAALPAPAFFTAVTQLEPHGLELAAVSTTPERQTLVSLAQPTPKYPHEVNGTPMYLYEVATESVCESAARLLFMSIKWAKSVPAFSTLSLQDQLMLLEDAWRELFVLGIAQWAIPVDANTLLAVSGMNGDNTDSQKLNKIISEIQALQEVVARFRQLRLDATEFACLKCIVTFKAVPTHSGSELRSFRNAAAIAALQDEAQLTLNSYIHTRYPTQPCRFGKLLLLLPALRSISPSTIEEVFFKKTIGNVPITRLLSDMYKSSDI

SEQ ID NO: 56156 - protein, 385 aa, Homo sapiens
MSKPAGSTSRILDIPCKVCGDRSSGKHYGVYACDGCSGFFKRSIRRNRTYVCKSGNQGGCPVDKTHRNQCRACRLKKCLEVNMNKDAVQHERGPRTSTIRKQVALYFRGHKEENGAAAHFPSAALPAPAFFTAVTQLEPHGLELAAVSTTPERQTLVSLAQPTPKYPHEVNGTPMYLYEVATESVCESAARLLFMSIKWAKSVPAFSTLSLQDQLMLLEDAWRELFVLGIAQWAIPVDANTLLAVSGMNGDNTDSQKLNKIISEIQALQEVVARFRQLRLDATEFACLKCIVTFKAVPTHSGSELRSFRNAAAIAALQDEAQLTLNSYIHTRYPTQPCRFGKLLLLLPALRSISPSTIEEVFFKKTIGNVPITRLLSDMYKSSDI

SEQ ID NO: 56157 - protein, 46 aa, Homo sapiens
MNKDAVQHERGPRTSTIRKQVALYFRGHKEENGAAAHFPSAALPAP

SEQ ID NO: 56158 - protein, 423 aa, Homo sapiens
MAMVVSSWRDPQDDVAGGNPGGPNPAAQAARGGGGGAGEQQQQAGSGAPHTPQTPGQPGAPATPGTAGDKGQGPPGSGQSQQHIECVVCGDKSSGKHYGQFTCEGCKSFFKRSVRRNLTYTCRANRNCPIDQHHRNQCQYCRLKKCLKVGMRREAVQRGRMPPTQPNPGQYALTNGDPLNGHCYLSGYISLLLRAEPYPTSRYGSQCMQPNNIMGIENICELAARLLFSAVEWARNIPFFPDLQITDQVSLLRLTWSELFVLNAAQCSMPLHVAPLLAAAGLHASPMSADRVVAFMDHIRIFQEQVEKLKALHVDSAEYSCLKAIVLFTSDACGLSDAAHIESLQEKSQCALEEYVRSQYPNQPSRFGKLLLRLPSLRTVSSSVIEQLFFVRLVGKTPIETLIRDMLLSGSSFNWPYMSIQCS

SEQ ID NO: 56159 - protein, 414 aa, Homo sapiens
MAMVVSTWRDPQDEVPGSQGSQASQAPPVPGPPPGAPHTPQTPGQGGPASTPAQTAAGGQGGPGGPGSDKQQQQQHIECVVCGDKSSGKHYGQFTCEGCKSFFKRSVRRNLSYTCRANRNCPIDQHHRNQCQYCRLKKCLKVGMRREAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 56160 - protein, 261 aa, Homo sapiens
MPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 56161 - protein, 281 aa, Homo sapiens
MQAVWDLEQGKYGFAVQRGRMPPTQPTHGQFALTNGDPLNCHSYLSGYISLLLRAEPYPTSRFGSQCMQPNNIMGIENICELAARMLFSAVEWARNIPFFPDLQITDQVALLRLTWSELFVLNAAQCSMPLHVAPLLAAAGLHASPMSADRVVAFMDHIRIFQEQVEKLKALHVDSAEYSCLKAIVLFTSDACGLSDVAHVESLQEKSQCALEEYVRSQYPNQPTRFGKLLLRLPSLRTVSSSVIEQLFFVRLVGKTPIETLIRDMLLSGSSFNWPYMAIQ

SEQ ID NO: 56162 - protein, 261 aa, Homo sapiens; identical to SEQ ID NO: 56160

SEQ ID NO: 56163 - protein, 404 aa, Homo sapiens
MAMVTGGWGGPGGDTNGVDKAGGYPRAAEDDSASPPGAASDAEPGDEERPGLQVDCVVCGDKSSGKHYGVFTCEGCKSFFKRSIRRNLSYTCRSNRDCQIDQHHRNQCQYCRLKKCFRVGMRKEAVQRGRIPHSLPGAVAASSGSPPGSALAAVASGGDLFPGQPVSELIAQLLRAEPYPAAAGRFGAGGGAAGAVLGIDNVCELAARLLFSTVEWARHAPFFPELPVADQVALLRLSWSELFVLNAAQAALPLHTAPLLAAAGLHAAPMAAERAVAFMDQVRAFQEQVDKLGRLQVDSAEYGCLKAIALFTPDACGLSDPAHVESLQEKAQVALTEYVRAQYPSQPQRFGRLLLRLPALRAVPASLISQLFFMRLVGKTPIETLIRDMLLSGSTFNWPYGSGQ

SEQ ID NO: 56164 - protein, 377 aa, Homo sapiens
MAMVTGGWGGPGGDAEPGDEERPGLQVDCVVCGDKSSGKHYGVFTCEGCKSFFKRSIRRNLSYTCRSNRDCQIDQHHRNQCQYCRLKKCFRVGMRKEAVQRGRIPHSLPGAVAASSGSPPGSALAAVASGGDLFPGQPVSELIAQLLRAEPYPAAAGRFGAGGGAAGAVLGIDNVCELAARLLFSTVEWARHAPFFPELPVADQVALLRLSWSELFVLNAAQAALPLHTAPLLAAAGLHAAPMAAERAVAFMDQVRAFQEQVDKLGRLQVDSAEYGCLKAIALFTPDACGLSDPAHVESLQEKAQVALTEYVRAQYPSQPQRFGRLLLRLPALRAVPASLISQLFFMRLVGKTPIETLIRDMLLSGSTFNWPYGSGQ

SEQ ID NO: 56165 - protein, 706 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGERRCISLPCMNYARGCTKSAFSSFDCSSPLKNTPS

SEQ ID NO: 56166 - protein, 984 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 56167 - protein, 988 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGKCSWQHNYLCAGRNDCIIDKIRRKNCPACRLQKCLQAGMNLGARKSKKLGKLKGIHEEQPQQQQPPPPPPPPQSPEEGTTYIAPAKEPSVNTALVPQLSTISRALTPSPVMVLENIEPEIVYAGYDSSKPDTAENLLSTLNRLAGKQMIQVVKWAKVLPGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 56168 - protein, 984 aa, Homo sapiens; identical to SEQ ID NO: 56166

SEQ ID NO: 56169 - protein, 988 aa, Homo sapiens; identical to SEQ ID NO: 56167

SEQ ID NO: 56170 - protein, 867 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKICLVCGDEASGCHYGVVTCGSCKVFFKRAVEGQHNYLCAGRNDCIIDKIRRKNCPACRLQKCLQAGMNLGGFKNLPLEDQITLIQYSWMCLSSFALSWRSYKHTNSQFLYFAPDLVFNEEKMHQSAMYELCQGMHQISLQFVRLQLTFEEYTIMKVLLLLSTIPKDGLKSQAAFEEMRTNYIKELRKMVTKCPNNSGQSWQRFYQLTKLLDSMHDLVSDLLEFCFYTFRESHALKVEFPAMLVEIISDQLPKVESGNAKPLYFHRK

SEQ ID NO: 56171 - protein, 639 aa, Homo sapiens
METKGYHSLPEGLDMERRWGQVSQAVERSSLGPTERTDENNYMEIVNVSCVSGAIPNNSTQGSSKEKQELLPCLQQDNNRPGILTSDIKTELESKELSATVAESMGLYMDSVRDADYSYEQQNQQGSMSPAKIYQNVEQLVKFYKGNGHRPSTLSCVNTPLRSFMSDSGSSVNGGVMRAVVKSPIMCHEKSPSVCSPLNMTSSVCSPAGINSVSSTTASFGSFPVHSPITQGTPLTCSPNVENRGSRSHSPAHASNVGSPLSSPLSSMKSSISSPPSHCSVKSPVSSPNNVTLRSSVSSPANINNSRCSVSSPSNTNNRSTLSSPAASTVGSICSPVNNAFSYTASGTSAGSSTLRDVVPSPDTQEKGAQEVPFPKTEEVESAISNGVTGQLNIVQYIKPEPDGAFSSSCLGGNSKINSDSSFSVPIKQESTKHSCSGTSFKGNPTVNPFPFMDGSYFSFMDDKDYYSLSGILGPPVPGFDGNCEGSGFPVGIKQEPDDGSYYPEASIPSSAIVGVNSGGQSFHYRIGAQGTISLSRSARDQSFQHLSSFPPVNTLVESWKSHGDLSSRRSDGYPVLEYIPENVSSSTLRSVSTGSSRPSKKNIYRFLLCNNRTRGVGQQLPLSPRSSTVFCITGIHTR

SEQ ID NO: 56172 - protein, 598 aa, Homo sapiens
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 56173 - protein, 611 aa, Homo sapiens
MWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 56174 - protein, 598 aa, Homo sapiens; identical to SEQ ID NO: 56172

SEQ ID NO: 56175 - protein, 598 aa, Homo sapiens; identical to SEQ ID NO: 56172

SEQ ID NO: 56176 - protein, 652 aa, Homo sapiens
MTSAQYKIKILIEGLHHGQRPGPAPPRQPGSFCWALKADGIMWLAKACWSIQSEMPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKRTVQKNAKYICLANKDCPVDKRRRNRCQFCRFQKCLAVGMVKEVVRTDSLKGRRGRLPSKPKQPPDASPANLLTSLVRAHLDSGPSTAKLDYSKFQELVLPHFGKEDAGDVQQFYDLLSGSLEVIRKWAEKIPGFAELSPADQDLLLESAFLELFILRLAYRSKPGEGKLIFCSGLVLHRLQCARGFGDWIDSILAFSRSLHSLLVDVPAFACLSALVLITDRHGLQEPRRVEELQNRIASCLKEHVAAVAGEPQPASCLSRLLGKLPELRTLCTQGLQRIFYLKLEDLVPPPPIIDKIFMDTLPF

SEQ ID NO: 56177 - protein, 325 aa, Homo sapiens
MPCIQAQYGTPAPSPGPRDHLASDPLTPEFIKPTMDLASPEAAPAAPTALPSFSTFMDGYTGEFDTFLYQLPGTVQPCSSASSSASSTSSSSATSPASASFKFEDFQVYGCYPGPLSGPVDEALSSSGSDYYGSPCSAPSPSTPSFQPPQLSPWDGSFGHFSPSQTYEGLRAWTEQLPKASGPPQPPAFFSFSPPTGPSPSLAQSPLKLFPSQATHQLGEGESYSMPTAFPGLAPTSPHLEGSGILDTPVTSTKARSGAPGGSEGRCAVCGDNASCQHYGVRTCEGCKGFFKVPRSPRWGLLLEMERGWPHPIGTCGLPLGSPPS

SEQ ID NO: 56178 - protein, 611 aa, Homo sapiens; identical to SEQ ID NO: 56173

SEQ ID NO: 56179 - protein, 598 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 56180 - protein, 598 aa, Homo sapiens; identical to SEQ ID NO: 56179

SEQ ID NO: 56181 - protein, 392 aa, Homo sapiens
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRI

SEQ ID NO: 56182 - protein, 392 aa, Homo sapiens; identical to SEQ ID NO: 56181

SEQ ID NO: 56183 - protein, 258 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPS

SEQ ID NO: 56184 - protein, 535 aa, Homo sapiens
MDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 56185 - protein, 609 aa, Homo sapiens
MNEDRRGELLTMPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRGSPSNEGLCAVCGDNAACQHYGVRTCEGCKGFFKRTVQKNAKYVCLANKNCPVDKRRRNRCQYCRFQKCLAVGMVKEVVRTDSLKGRRGRLPSKPKSPQEPSPPSPPVSLISALVRAHVDSNPAMTSLDYSRFQANPDYQMSGDDTQHIQQFYDLLTGSMEIIRGWAEKIPGFADLPKADQDLLFESAFLELFVLRLAYRSNPVEGKLIFCNGVVLHRLQCVRGFGEWIDSIVEFSSNLQNMNIDISAFSCIAALAMVTERHGLKEPKRVEELQNKIVNCLKDHVTFNNGGLNRPNYLSKLLGKLPELRTLCTQGLQRIFYLKLEDLVPPPAIIDKLFLDTLPF

SEQ ID NO: 56186 - protein, 245 aa, Homo sapiens
VEEEGDVSNRGVELLQLEPDEDQVRARILGCLQEPTKSRPDQPAAFGLLCRMADQTFISIVDWARRCMVFKELEVADQMTLLQNCWSELLVFDHIYRQVQHGKEGSILLVTGQEVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 56187 - protein, 461 aa, Homo sapiens
MDYSYDEDLDELCPVCGDKVSGYHYGLLTCESCKGFFKRTVQNNKHYTCTESQSCKIDKTQRKRCPFCRFQKCLTVGMRLEAVRADRMRGGRNKFGPMYKRDRALKQQKKAQIRANGFKLETGPPMGVPPPPPPAPDYVLPPSLHGPEPKGLAAGPPAGPLGDFGAPALPMAVPGAHGPLAGYLYPAFPGRAIKSEYPEPYASPPQPGLPYGYPEPFSGGPNVPELILQLLQLEPDEDQVRARILGCLQEPTKSRPDQPAAFGLLCRMADQTFISIVDWARRCMVFKELEVADQMTLLQNCWSELLVFDHIYRQVQHGKEGSILLVTGQEVELTTVATQAGSLLHSLVLRAQELVLQLLALQLDRQEFVCLKFIILFSLDLKFLNNHILVKDAQEKANAALLDYTLCHYPHCGDKFQQLLLCLVEVRALSMQAKEYLYHKHLGNEMPRNNLLIEMLQAKQT

SEQ ID NO: 56188 - protein, 178 aa, Homo sapiens
MDYSYDEDLDELCPVCGDKVSGYHYGLLTCESCKGFFKRTVQNNKHYTCTESQSCKIDKTQRKRCPFCRFQKCLTVGMRLEAVRADRMRGGRNKFGPMYKRDRALKQQKKAQIRANGFKLETGPPMGVPPPPPPAPDYVLPPSLHGPEPKGLAAGPPAGPLGDFGAPALPMAVPGAHG

SEQ ID NO: 56189 - protein, 323 aa, Homo sapiens
DLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKGLTLSPSLECSGSWLMATSTSCIQVIRLPQPPE

SEQ ID NO: 56190 - protein, 495 aa, Homo sapiens
MSSNSDTGDLQESLKHGLTPIVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 56191 - protein, 377 aa, Homo sapiens
  MOD_RES (1)..(1): Any amino acid
XDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKGLTLSPSLECSGTILAHGNLHLLHSSDSPASASRVAGITGVHHNTHLIFVFLVEMGFCHVGQAGLKTPDLRVICLPRPPKVLGLWA

SEQ ID NO: 56192 - protein, 541 aa, Homo sapiens
MSSNSDTGDLQESLKHGLTPIGAGLPDRHGSPIPARGRLVMLPKVETEALGLARSHGEQGQMPENMQVSQFKMVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 56193 - protein, 71 aa, Homo sapiens
  MOD_RES (1)..(1): Any amino acid
XSLKHGLTPIDRGNCRSGCFSFAATLRQRSLLTSCAGLPDRHGSPIPARGRLVMLPKVETEALGLARSHGE

SEQ ID NO: 56194 - protein, 21 aa, Homo sapiens
MSSNSDTGDLQESLKHGLTPI

SEQ ID NO: 56195 - protein, 82 aa, Homo sapiens
MSSNSDTGDLQESLKHGLTPIDRGNCRSGCFSFAATLRQRSLLTSCAGLPDRHGSPIPARGRLVMLPKVETEALGLARSHGE

SEQ ID NO: 56196 - protein, 469 aa, Homo sapiens
MVNYSYDEDLEELCPVCGDKVSGYHYGLLTCESCKGFFKRTVQNNKRYTCIENQNCQIDKTQRKRCPYCRFQKCLSVGMKLEAVRADRMRGGRNKFGPMYKRDRALKQQKKALIRANGLKLEAMSQVIQAMPSDLTISSAIQNIHSASKGLPLNHAALPPTDYDRSPFVTSPISMTMPPHGSLQGYQTYGHFPSRAIKSEYPDPYTSSPESIMGYSYMDSYQTSSPASIPHLILELLKCEPDEPQVQAKIMAYLQQEQANRSKHEKLSTFGLMCKMADQTLFSIVEWARSSIFFRELKVDDQMKLLQNCWSELLILDHIYRQVVHGKEGSIFLVTGQQVDYSIIASQAGATLNNLMSHAQELVAKLRSLQFDQREFVCLKFLVLFSLDVKNLENFQLVEGVQEQVNAALLDYTMCNYPQQTEKFGQLLLRLPEIRAISMQAEEYLYYKHLNGDVPYNNLLIEMLHAKRA

SEQ ID NO: 56197 - protein, 503 aa, Homo sapiens
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGLVQIPVSMYQTVVTSLAQGNGPVQVAMAPVTTRISDSAVTMDGQAVEVVTLEQ

SEQ ID NO: 56198 - protein, 522 aa, Homo sapiens
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGLFMADRAGRKWILTDKATGLVQIPVSMYQTVVTSLAQGNGPVQVAMAPVTTRISDSAVTMDGQAVEVVTLEQ

SEQ ID NO: 56199 - protein, 437 aa, Homo sapiens
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGLVQIPVSMYQTVVTSLAQGNGPVQVAMAPVTTRISDSAVTMDGQAVEVVTLEQ

SEQ ID NO: 56200 - protein, 503 aa, Homo sapiens; identical to SEQ ID NO: 56197

SEQ ID NO: 56201 - protein, 522 aa, Homo sapiens; identical to SEQ ID NO: 56198

SEQ ID NO: 56202 - protein, 503 aa, Homo sapiens; identical to SEQ ID NO: 56197

SEQ ID NO: 56203 - protein, 210 aa, Homo sapiens
MEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIP

SEQ ID NO: 56204 - protein, 342 aa, Homo sapiens
MILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANGLVQIPVSMYQTVVTSLAQGNGPVQVAMAPVTTRISDSAVTMDGQAVEVVTLEQ

SEQ ID NO: 56205 - protein, 619 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYISAIRERFPKLLRLDGHELPPPIAFDVEAPTTLPPCKGSYFGTENLKSLVLHFLQQYYAIYDSGDRQGLLDAYHDGACCSLSIPFIPQNPARSSLAEYFKDSRNVKKLKDPTLRFRLLKHTRLNVVAFLNELPKTQHDVNSFVVDISAQTSTLLCFSVNGVFKEVDGKSRDSLRAFTRTFIAVPASNSGLCIVNDELFVRNASSEEIQRAFAMPAPTPSSSPVPTLSPEQQEMLQAFSTQSGMNLEWSQKCLQDNNWDYTRSAQAFTHLKAKGEIPEVAFMK

SEQ ID NO: 56206 - protein, 356 aa, Homo sapiens
MADEGKSYSEHDDERVNFPQRKKKGRGPFRWKYGEGNRRSGRGGSGIRSSRLEEDDGDVAMSDAQDGPRVRYNPYTTRPNRRGDTWHDRDRIHVTVRRDRAPPERGGAGTSQDGTSKNWFKITIPYGRKYDKAWLLSMIQSKCSVPFTPIEFHYENTRAQFFVEDASTASALKAVNYKILDRENRRISIIINSSAPPHTILNELKPEQVEQLKLIMSKRYDGSQQALDLKGLRSDPDLVAQNIDVVLNRRSCMAATLRIIEENIPELLSLNLSNNRLYRLDDMSSIVQKAPNLKILNLSGNELKSERELDKIKGLKLEELWLDGNSLCDTFRDQSTYIRSVVACVSPPGDLHPLGG

SEQ ID NO: 56207 - protein, 356 aa, Homo sapiens; identical to SEQ ID NO: 56206

SEQ ID NO: 56208 - protein, 619 aa, Homo sapiens; identical to SEQ ID NO: 56205

SEQ ID NO: 56209 - protein, 626 aa, Homo sapiens
MCSTLKKCGTYRTEVAECHDHGSTFQGRKKGGSSFRDNFDKRSCHYEHGGYERPPSHCQENDGSVEMRDVHKDQQLRHTPYSIRCERRMKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTERMLCFSVNGVFKEVEGQSQGSVLAFTRTFIATPGSSSSLCIVNDELFVRDASPQETQSAFSIPVSTLSSSSEPSLSQEQQEMVQAFSAQSGMKLEWSQKCLQDNEWNYTRAGQAFTMLQTEGKIPAEAFKQIS

SEQ ID NO: 56210 - protein, 626 aa, Homo sapiens; identical to SEQ ID NO: 56209

SEQ ID NO: 56211 - protein, 626 aa, Homo sapiens; identical to SEQ ID NO: 56209

SEQ ID NO: 56212 - protein, 409 aa, Homo sapiens
MKWHSEDEIRITTWRNRKPPERKMSQNTQDGYTRNWFKVTIPYGIKYDKAWLMNSIQSHCSDRFTPVDFHYVRNRACFFVQDASAASALKDVSYKIYDDENQKICIFVNHSTAPYSVKNKLKPGQMEMLKLTMNKRYNVSQQALDLQNLRFDPDLMGRDIDIILNRRNCMAATLKIIERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQYYSIYDSGDRQGLLGAYHDEACFSLAIPFDPKDSAPSSLCKYFEDSRNMKTLKDPYLKGELLRRTKRDIVDSLSALPKTQHDLSSILVDVWCQTVPSGQ

SEQ ID NO: 56213 - protein, 626 aa, Homo sapiens; identical to SEQ ID NO: 56209

SEQ ID NO: 56214 - protein, 531 aa, Homo sapiens
MSLPSGHTTGHTDQVVQRRARCWDIYQRRFSSRSEPVNPGMHSSSHQQQDGDAAMHGAHMDSPVRYTPYTISPYNRKGSFRKQDQTHVNMEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNINSILELFPKLLCLDGQQSPRATLCGTEAHKRLPTCKGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMLPS

SEQ ID NO: 56215 - protein, 233 aa, Homo sapiens
MEREQKPPERRMEGNMPDGTLGSWFKITVPFGIKYNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNIKSVVPSVTTWDPDLCLIAPFCRRRQH

SEQ ID NO: 56216 - protein, 203 aa, Homo sapiens
MASSHPEQLYVVLKPTRGYQPVRYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVEGQSQGSVLAFTRTFIATPGSSSSLCIVNDKLFVRDTSHQGTQSALFTLVPTAFSSSVPAFSQEQQKMLPS

SEQ ID NO: 56217 - protein, 361 aa, Homo sapiens
  MOD_RES (1)..(1): Any amino acid
XNEKWLLNLIQNECSVPFVPVEFHYENMHASFFVENASIAYALKNVSGKIWDEDNEKISIFVNPAGIPHFVHRELKSEKVEQIKLAMNQQCDVSQEALDIQRLPFYPDMVNRDTKMASNPRKCMAASLDVHEENIPTVMSAGEMDKWKGIEPGEKCADRSPVCTTFSDTSSNINSILELFPKLLCLDGQQSPRATLCGTEAHKRLPTCKGSFFGSEMLKNLVLQFLQQYYLIYDSGDRQGLLSAYHDEACFSLSIPFNPEDSAPSSFCKFFKDSRNIKILKDPYLRGELLKHTKLDIVDSLSALPKTQHDLSSFLVDMWYQTEWMLCFSVNGVFKEVSGFCSRLHPDLHCYPWQQFQSVHR

SEQ ID NO: 56218 - protein, 397 aa, Homo sapiens
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQRWWCLLSLKWKDGLRVLILPSCGPSSLPLAAIPVCAS

SEQ ID NO: 56219 - protein, 397 aa, Homo sapiens; identical to SEQ ID NO: 56218

SEQ ID NO: 56220 - protein, 365 aa, Homo sapiens
MRRNTQDENMRKWFKVTIPYGIKYDKAWLMNSIQSNCSVPFTPVDFHYIRNRACFFVQVASAASALKDVSYKIYDDENQKICIFVSHFTAPYSVKNKLKPGQMEMLKLTMNKRYNVSQQALDLQNLRFDPDLMGRDIDIILNRRNCMAATLKITERNFPELLSLNLCNNKLYQLDGLSDITEKAPKVKTLNLSKNKLESAWELGKVKGLKLEELWLEGNPLCSTFSDQSAYVSAIRDCFPKLLRLDGRELSAPVIVDIDSSETMKPCKENFTGSETLKHLVLQFLQQSNLCKYFKDSRNIKILKDPYLQRKLLKHTKCPRNVDSLSALPETQHDFTSILVDMWYQTVNTCFLPRAGPESQSLRPL

SEQ ID NO: 56221 - protein, 365 aa, Homo sapiens; identical to SEQ ID NO: 56220

SEQ ID NO: 56222 - protein, 347 aa, Homo sapiens
MEQYTANSNSSTEQIVVQAGQIQQQQQGGVTAVQLQTEAQVASASGQQVQTLQVVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQDPNQADEEAMTQIIRVS

SEQ ID NO: 56223 - protein, 318 aa, Homo sapiens
MEQYTANSNSSTEQIVVQAGQIQQQVQGQPLMVQVSGGQLITSTGQPIMVQAVPGGQGQTIMQVPVSGTQGLQQIQLVPPGQIQIQGGQAVQVQGQQGQTQQIIIQQPQTAVTAGQTQTQQQIAVQGQQVAQTAEGQTIVYQPVNADGTILQQVTVPVSGMITIPAASLAGAQIVQTGANTNTTSSGQGTVTVTLPVAGNVVNSGGMVMMVPGAGSVPAIQRIPLPGAEMLEEEPLYVNAKQYHRILKRRQARAKLEAEGKIPKERRKYLHESRHRHAMARKRGEGGRFFSPKEKDSPHMQDPNQADEEAMTQIIRVS

SEQ ID NO: 56224 - protein, 207 aa, Homo sapiens
MTMDGDSSTTDASQLGISADYIGGSHYVIQPHDDTEDSMNDHEDTNGSKESFREQDIYLPIANVARIMKNAIPQTGKIAKDAKECVQECVSEFISFITSEASERCHQEKRKTINGEDILFAMSTLGFDSYVEPLKLYLQKFREAMKGEKGIGGAVTATDGLSEELTEEAFTNQLPAGLITTDGQQQNVMVYTTSYQQISGVQQIQFS

SEQ ID NO: 56225 - protein, 207 aa, Homo sapiens; identical to SEQ ID NO: 56224

SEQ ID NO: 56226 - protein, 458 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 56227 - protein, 335 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 56228 - protein, 439 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQRNSVQQARVSELTGEAEPREVKATGNSTPCTSSLPTTHPPSHRAGASCVCCSQPQQSSTSPPPSDALQWVVVEVSGTPNQLETHRELHAPLPGMTSLSPLHPSQQLYQIQQVTMPAGQDLAQPMFIQSANQPSDGQAPQVTGD

SEQ ID NO: 56229 - protein, 301 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 56230 - protein, 335 aa, Homo sapiens; identical to SEQ ID NO: 56227

SEQ ID NO: 56231 - protein, 233 aa, Homo sapiens
MAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMRARTSPSPCSSSQPTSPPTGPPGDRRLRA

SEQ ID NO: 56232 - protein, 201 aa, Homo sapiens
MAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTQAMETFFAFKRQIYSLWRVGGFIATLFSPRDPGN

SEQ ID NO: 56233 - protein, 313 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPETGLAVSLRLMKCSGLISAHCSFRLPGSSDSPASASRVAGIIGAAECRPAAVYPLSPACIRHSSCAGTDPDTC

SEQ ID NO: 56234 - protein, 180 aa, Homo sapiens [sequence omitted]

SEQ ID NO: 56235 - protein, 354 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQGQRNASQGKPRRCLKETLQITQTEVQQGQQQFSQFTDGQQLYQIQQVTMPAGQDLAQPMFIQSANQPSDGQAPQVTGD

SEQ ID NO: 56236 - protein, 297 aa, Homo sapiens
MSTEGGFGGTSSSDAQQSLQSFWPRVMEEIRNLTVKDFRVQELPLARIKKIMKLDEDVKRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQQLYQIQQVTMPAGQDLAQPMFIQSANQPSDGQAPQVTGD

SEQ ID NO: 56237 - protein, 335 aa, Homo sapiens; identical to SEQ ID NO: 56227

SEQ ID NO: 56238 - protein, 335 aa, Homo sapiens; identical to SEQ ID NO: 56227

SEQ ID NO: 56239 - protein, 129 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQ

SEQ ID NO: 56240 - protein, 334 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEEVRQSVTPAEPVQYYFTLAQQPTAVQVQGQQQGQQTTSSTTTIQPGQIIIAQPQQGQTTPVTMQVGEGQQVQIVQAQPQGQAQQAQSGTGQTMQVMQQIITNTGEIQQIPVQLNAGQLQYIRLAQPVSGTQVVQGQIQTLATNAQQITQTEVQQGQQQFSQFTDGQLYQIQQVTMPAGQDLAQPMFIQSANQPSDGQAPQVTGD

SEQ ID NO: 56241 - protein, 141 aa, Homo sapiens
MSTEGGFGGTSSSDAQQSLQSFWPRVMEEIRNLTVKDFRVQELPLARIKKIMKLDEDVKMISAEAPVLFAKAAQIFITELTLRAWIHTEDNKRRTLQRNDIAMAITKFDQFDFLIDIVPRDELKPPKRQEVRQSVTPAEPV

SEQ ID NO: 56242 - protein, 95 aa, Homo sapiens
MSTEGGFGGTSSSDAQQSLQSFWPRVMEEIRNLTVMISAEAPVLFAKAAQIFITELTLRAWIHTEDNKRRTLQRNDIAMAITKFDQFDFLIDIVP

SEQ ID NO: 56243 - protein, 60 aa, Homo sapiens
MSTEGGFGGTSSSDAQQSLQSFWPRVMEEIRNLTVKDFRVQELPLARIKKIMKLDEDVKM

SEQ ID NO: 56244 - protein, 52 aa, Homo sapiens
MSTEGGFGGTSSSDAQQSLQSFWPRVMEEIRNLTVKDFRVQELPLARIKKIM

SEQ ID NO: 56245 - protein, 197 aa, Homo sapiens
MRKYRSHWSQGDREGYQRRSNYYEGPHTSHSSPADRTREEVVTPTLPEHTATRSQMATSLDFKTYVDQACRAAEEFVNIYYETMDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 56246 - protein, 114 aa, Homo sapiens
MDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 56247 - protein, 142 aa, Homo sapiens
MATSLDFKTYVDQACRAAEEFVNIYYETMDKRRRALTRLYLDKATLIWNGNAVSGLDALNNFFDTLPSSEFQVNMLDCQPVHEQATQSQTTVLVVTSGTVKFDGNKQHFFNQNFLLTAQSTPNNTVWKIASDCFRFQDWSSS

SEQ ID NO: 56248 - protein, 114 aa, Homo sapiens; identical to SEQ ID NO: 56246

SEQ ID NO: 56249 - protein, 293 aa, Homo sapiens
MTGLYELVWRVLHALLCLHRTLTSWLRVRFGTWNWIWRRCCRAASAAVLAPLGFTLRKPPAVGRNRRHHRHPRGGSCLAAAHHRMRWRADGRSLEKLPVHMGLVITEVEQEPSFSDIASLVVWCMAVGISYISVYDHQGIFKRNNSRLMDEILKQQQELLGLDCSKYSPEFANSNDKDDQVLNCHLAVKVLSPEDGKADIVRAAQDFCQLVAQKQKRPTDLDVDTLASLLSSNGCPDPDLVLKFGPVDSTLGFLPWHIRLTEIVSLPSHLNISYEDFFSALRQYAACEQRLGK

SEQ ID NO: 56250 - protein, 856 aa, Homo sapiens
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 56251 - protein, 667 aa, Homo sapiens
MKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGAECSGMITAHCSFDFSGSNDPPASASQELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 56252 - protein, 589 aa, Homo sapiens
MEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDREI

SEQ ID NO: 56253 - protein, 750 aa, Homo sapiens
MEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 56254 - protein, 765 aa, Homo sapiens
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQDSKDSSLLESDMKRKGKLKNKGSKRKKEDLQEVDGEIEAVLQKKAKARGLEFQISNVKFEDVGGNDMTLKEVCKMLIHMRHPEVYHHLGVVPPRGVLLHGPPGCGKTLLAHAIAGELDLPILKVAAPEIVSGVSGESEQKLRELFEQAVSNAPCIIFIDEIDAITPKREVASKDMERRIVAQLLTCMDDLNNVAATARVLVIGATNRPDSLDPALRRAGRFDREICLGIPDEASRERILQTLCRKLRLPQAFDFCHLAHLTPGFVGADLMALCREAAMCAVNRVLMKLQEQQKKNPEMEDLPSKGVQEERLGTEPTSETQDELQRLLGLLRDQDPLSEEQMQGLCIELNDFIVALSSVQPSAKREGFVTVPNVTWADIGALEDIREELTMAILAPVRNPDQFKALGLVTPAGVLLAGPPGCGKTLLAKAVANESGLNFISVKGPELLNMYVGESERAVRQVFQRAKNSAPCVIFFDEVDALCPRRSDRETGASVRVVNQLLTEMDGLEARQQVFIMAATNRPDIIDPAILRPGRLDKTLFVGLPPPADRLAILKTITKNGTKPPLDADVNLEAIAGDLRCDCYTGADLSALVREASICALRQEMARQKSGNEKGELKVSHKHFEEAFKKVRSSISKKDQIMYERLQESLSR

SEQ ID NO: 56255 - protein, 461 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQDPNVQVDHLNLLKQFEHLDPQNQHTFEARDLELLIQTATRDLAQYDAAHHEEFKRYEMLKEHERRRYLESLGEEQRKEAERKLEEQQRRHREHPKVNVPGSQAQLKEVWEELDGLDPNRFNPKTFFILHDINSDGVLDEQELEALFTKELEKVYDPKNEEDDMREMEEERLRMREHVMKNVDTNQDRLVTLEEFLASTQRKEFGDTGEGWETVEMHPAYTEEELRRFEEELAAREAELNAKAQRLSQETEALGRSQGRLEAQKRELQQAVLHMEQRKQQQQQQQGHKAPAAHPEGQLKFHPDTDDVPVPAPAGDQKEVDTSEKKLLERLPEVEVPQHL

SEQ ID NO: 56256 - protein, 461 aa, Homo sapiens; identical to SEQ ID NO: 56255

SEQ ID NO: 56257 - protein, 461 aa, Homo sapiens; identical to SEQ ID NO: 56255

SEQ ID NO: 56258 - protein, 124 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRLRMLLKAKMDAEQD

SEQ ID NO: 56259 - protein, 111 aa, Homo sapiens
MPPSGPRGTLLLLPLLLLLLLRAVLAVPLERGAPNKEETPATESPDTGLYYHRYLQEVIDVLETDGHFREKLQAANAEDIKSGKLSRELDFVSHHVRTKLDELKRQEVSRL

SEQ ID NO: 56260 - protein, 420 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMSEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPRV

SEQ ID NO: 56261 - protein, 390 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMSETLDQQQFFTEEELKEYENIIALQENELKKKADELQKQKEELQRQHDQLEAQKLEYHQVIQQMEQKKLQQGIPPSGPAGELKFEPHI

SEQ ID NO: 56262 - protein, 69 aa, Homo sapiens
MRWRTILLQYCFLLITCLLTALEAVPIDIDKTKVQNIHPVESAKIEPPDTGLYYDEYLKQVIDVLETDK

SEQ ID NO: 56263 - protein, 34 aa, Homo sapiens
MRWRTILLQYCFLLITCLLTALEAVPIDIDKTKV

SEQ ID NO: 56264 - protein, 420 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEEKRKEEESKFEEMKKKHENHPKVNHPGSKDQLKEVWEETDGLDPNDFDPKTFFKLHDVNSDGFLDEQELEALFTKELEKVYDPKNEEDDMVEMEEERLRMREHVMSEVDTNKDRLVTLEEFLKATEKKEFLEPDSWETLDQQQFFTEEELKEYENIIALQENELKKKADELQKQKEELQRQHDQLEAQKLEYHQVIQQMEQKKLQQGIPPSGPAGELKFEPHI

SEQ ID NO: 56265 - protein, 195 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTL

SEQ ID NO: 56266 - protein, 198 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSKELDLVSHHVRTKLDELKRQEVGRLRMLIKAKLDSLQDIGMDHQALLKQFDHLNHLNPDKFESTDLDMLIKAATSDLEHYDKTRHEEFKKYEMMKEHERREYLKTLNEE

SEQ ID NO: 56267 - protein, 34 aa, Homo sapiens; identical to SEQ ID NO: 56263

SEQ ID NO: 56268 - protein, 39 aa, Homo sapiens
MRWRTILLQYCFLLITCLLTALEAVPIDIDKTKVQNIHP

SEQ ID NO: 56269 - protein, 69 aa, Homo sapiens; identical to SEQ ID NO: 56262

SEQ ID NO: 56270 - protein, 90 aa, Homo sapiens
MRWRTILLQYCFLLITCLLTALEAVPIDIDKTKVQNIHPVESAKIEPPDTGLYYDEYLKQVIDVLETDKHFREKLQKADIEEIKSGRLSK

SEQ ID NO: 56271 - protein, 440 aa, Homo sapiens
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 56272 - protein, 402 aa, Homo sapiens
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAGKLKPWGQSKENNYLNQHVNRINFYKKTYKQPHLQTKEEQRKKREQERKEKKAKVLGMRRGLILAED

SEQ ID NO: 56273 - protein, 441 aa, Homo sapiens
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 56274 - protein, 440 aa, Homo sapiens
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 56275 - protein, 439 aa, Homo sapiens
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQNHSEIKISNPTEFQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 56276 - protein, 426 aa, Homo sapiens
MIIPSLEELDSLKYSDLQNLAKSLGLRANLRATKLLKALKGYIKHEARKGNENQDESQTSASSCDETEIQISNQEEAERQPLGHVTKTRRRCKTVRVDPDSQNHEKQESQDLRATAKVPSPPDEHQEAENAVSSGNRDSKVPSEGKKSLYTDESSKPGKNKRTAITTPNFKKLHEAHFKEMESIDQYIERKKKHFEEHNSMNELKQQPINKGGVRTPVPPRGRLSVASTPISQRRSQGRSCGPASQSTLGLKGSLKRSAISAAKTGVRFSAATKDNEHKRSLTKTPARKSAHVTVSGGTPKGEAVLGTHKLKTITGNSAAVITPFKLTTEATQTPVSNKKPVFDLKASLSRPLNYEPHKGKLKPWGQSKENNYLNQHVNRINFYKKTYKQPHLQTKEEQRKKREQERKEKKAKVLGMRRGLILAED

SEQ ID NO: 56277 - protein, 749 aa, Homo sapiens [sequence omitted]

SEQ ID NO: 56278 - protein, 800 aa, Homo sapiens
MKFRRNKKQIPSFRKLIKTSKVKLENKLKNKQFKQQSTLKKYRKEQRKLRQAVKDAVSKKPIPLENPKEKRPGKRIEREEEEEEEALPLDMMDEDDLQLMKDLGQRVSFLTRDLSSSEPVHAKKRKHERIIDKYEKIPRTLQTAPEKELIHLLPIKDKSGIIPQTREKPVTDSNKDEEDQEEERELEEEIIEDPIQELTIEEHLIERKKKLQEKKMHIAALASAILSDPENNIKKLKELRSMLMEQDPDVAVTVRKLVIVSLMELFKDITPSYKIRPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLISEMCCEAVKKLFKQDKLGQASLGVIKVISGFVKGRNYEVRPEMLKTFLCLRIKEVEVKKDTEDINKPKKFMTFKEKRKSLSRMQRKWKKAEEKLERELREAEASESTEKKLKLHTETLNIVFVTYFRILKKAQRSPLLPAVLEGLAKFAHLINVEFFDDLLVVLHTLIESGDLSYQESLHCVQTAFHILSGQGDVLNIDPLKFYTHLYKTLFKLHAGATNEGVEIVLQCLDVMLTKRRKQVSQQRALAFIKRLCTLALHVLPNSSIGILATTRILMHTFPKTDLLLDSESQGSGVFLPELDEPEYCNAQNTALWELHALRRHYHPIVQRFAAHLIAGAPSEGSGALKPELSRRSATELFEAYSMAEMTFNPPVESSNPKIKGKFLQGDSFLNEDLNQLIKRYSSEVATESPLDFTKYLKTSLH

SEQ ID NO: 56279 - protein, 800 aa, Homo sapiens
MKARRNKKQIPSFRKLIKTSKVKLENKLKNKQFKQQSTLKKYRKEQRKLRQAVKDAVSKKPIPLENPKEKRPGKRIEREEEEEEEALPLDMMDEDDLQLMKDLGQRVSFLTRDLSSSEPVHAKKRKHERIIDKYEKIPRTLQTAPEKELIHLLPIKDKSGIIPQTREKPVTDSNKDEEDQEEERELEEEIIEDPIQELTIEEHLIERKKKLQEKKMHIAALASAILSDPENNIKKLKELRSMLMEQDPDVAVTVRKLVIVSLMELFKDITPSYKIRPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLISEMCCEAVKKLFKQDKLGQASLGVIKVISGFVKGRNYEVRPEMLKTFLCLRIKEVEVKKDTEDINKPKKFMTFKEKRKSLSRMQRKWKKAEEKLERELREAEASESTEKKLKLHTETLNIVFVTYFRILKKAQRSPLLPAVLEGLAKFAHLINVEFFDDLLVVLHTLIESGDLSYQESLHCVQTAFHILSGQGDVLNIDPLKFYTHLYKTLFKLHAGATNEGVEIVLQCLDVMLTKRRKQVSQQRALAFIKRLCTLALHVLPNSSIGILATTRILMHTFPKTDLLLDSESQGSGVFLPELDEPEYCNAQNTALWELHALRRHYHPIVQRFAAHLIAGAPSEGSGALKPELSRRSATELFEAYSMAEMTFNPPVESSNPKIKGKFLQGDSFLNEDLNQLIKRYSSEVATESPLDFTKYLKTSLH

SEQ ID NO: 56280 - protein, 501 aa, Homo sapiens
MELFKDITPSYKIRPLTEAEKSTKTRKETQKLREFEEGLVSQYKFYLENLEQMVKDWKQRKLKKSNVVSLKAYKGLAEVAVKSLCELLVALPHFNFHNNIIVLIVPLMNDMSKLISEMCCEAVKKLFKQDKLGQASLGVIKVISGFVKGRNYEVRPEMLKTFLCLRIKEVEVKKDTEDINKPKKFMTFKEKRKSLSRMQRKWKKAEEKLERELREAEASESTEKKLKLHTETLNIVFVTYFRILKKAQRSPLLPAVLEGLAKFAHLINVEFFDDLLVVLHTLIESGDLSYQESLHCVQTAFHILSGQGDVLNIDPLKFYTHLYKTLFKLHAGATNEGVEIVLQCLDVMLTKRRKQVSQQRALAFIKRLCTLALHVLPNSSIGILATTRILMHTFPKTDLLLDSESQGSGVFLPELDEPEYCNAQNTALWELHALRRHYHPIVQRFAAHLIAGAPSEGSGALKPELSRRSATELFEAYSMAEMTFNPPVESSNPKIKVTTKG

SEQ ID NO: 56281 - protein, 516 aa, Homo sapiens
MEREPGAAGVRRALGRRLEAVLASRSEANAVFDILAVLQSEDQEEIQEAVRTCSRLFGALLERGELFVGQLPSEEMVMTGSQGATRKYKVWMRHRYHSCCNRLGELLGHPSFQVKELALSALLKFVQLEGAHPLEKSKWEGNYLFPRELFKLVVGGLLSPEEDQSLLLSQFREYLDYDDTRYHTMQAAVDAVARVTGQHPEVPPAFWNNAFTLLSAVSLPRREPTVSSFYVKRAELWDTWKVAHLKEHRRVFQAMWLSFLKHKLPLSLYKKVLLIVHDAILPQLAQPTLMIDFLTRACDLGGALSLLALNGLFILIHKHNLEYPDFYRKLYGLLDPSVFHVKYRARFFHLADLFLSSSHLPAYLVAAFAKRLARLALTAPPEALLMVLPFICNLLRRHPACRVLVHRPHGPELDADPYDPGEEDPAQSRALESSLWELQALQRHYHPEVSKAASVINQALSMPEVSIAPLLELTAYEIFERDLKKKGPEPVPLEFIPAQGLLGRPGELCAQHFTLS

SEQ ID NO: 56282 - protein, 83 aa, Homo sapiens
  MOD_RES (1)..(1): Any amino acid
XPEELTFASAQAEAREEERRVRETVRRDKTLLKEKRKRREELFIEQKKRKLLPDTILEKLTTASQTNIKKSPGKVKEGMTILI

SEQ ID NO: 56283 - protein, 257 aa, Homo sapiens
MVQLRPRASRAPASAEAMVDEGQLASEEEEAEHGLLLGQPSSGAAAEPLEEDEEGDDEFDDEAPEELTFASAQAEAREEERRVRETVRRDKTLLKEKRKRREELFIEQKKRKLLPDTILEKLTTASQTNIKKSPGKVKEVNLQKKNEDCEKGNDSKKVKVQKVQSVSQNKSYLAVRLKDQDLRDSRQQAAQAFIHNSLYGPGTNRTTVNKFLSLANKRLPVKRAAVQFLNNAWGIQKKQNAKRFKRRWMVRKMKTKK

SEQ ID NO: 56284 - protein, 1099 aa, Homo sapiens
MSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 56285 - protein, 1131 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKHLRNIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 56286 - protein, 258 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRT

SEQ ID NO: 56287 - protein, 970 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKA

SEQ ID NO: 56288 - protein, 413 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFK

SEQ ID NO: 56289 - protein, 1167 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSKFGRVLPVLHLKNQHKRKIIKYDPSKYCHNLKKIGEDFSNTIPISSLTWELEGGNDPMSKKRRGEFSDFHGPPKKIIKVQKDESSTGSLAMSTRPRRVIERPPLTQQQAAQKRTCDSITPSKSSPVPVSDTQKLKNLPFKTSGLETAKKRNSISDDDTDSEDELRMMIAKEENLQRTTQPSINESESDPFEVVRDDFKSGVHKLHSLIGLGIKNRVSCHDSDDDIMRNDREYDSGDTDEIIAMKKNVAKVKNSTEFSQMEKSTKKTSFKNRENCELSDHCIKLQKRKSNVESALSHGLKSLNRKSPSHSSSSEDADSASELADSEGGEEYNAMMKNCLRVNLTLADLEQLAGSDLKVPNEDTKSDGPETTTQCKFDRGSKSPKTPTGLRRGRQCIRPAEIVASLLEGEENTCGKQKPKENNLKPKFQAFKGVGCLYEKESMKKSLKDSVASNNKDQNSMKHEDPSIISMEDGSPYVNGSLGEVTPCQHAKKANGPNYIQPQKRQTTFESQDRKAVSPSSSEKRSKNPISRPLEGKKSLSLSAKTHNIGFDKDSCHSTTKTEASQEERSDSSGLTSLKKSPKVSSKDTREIKTDFSLSISNSSDVSAKDKHAEDNEKRLAALEARQKAKEVQKKLVHNALANLDGHPEDKPTHIIFGSDSECETEETSTQEQSHPGEEWVKESMGKTSGKLFDSSDDDESDSEDDSNRFKIKPQFEGRAGQKLMDLQSHFGTDDRFRMDSRFLETDSEEEQEEVNEKKTAEEEELAEEKKKALNVVQSVLQINLSNSTNRGSVAAKKFKDIIHYDPTKQDHATYERKRDDKPKESKAKRKKKREEAEKLPEVSKEMYYNIAMDLKEIFQTTKYTSEKEEGTPWNEDCGKEKPEEIQDPAALTSDAEQPSGFTFSFFDSDTKDIKEETYRVETVKPGKIVWQEDPRLQDSSSEEEDVTEETDHRNSSPGEASLLEKETTRFFFFSKNDERLQGSDLFWRGVGSNMSRNSWEARTTNLRMDCRKKHKDAKRKMKPK

SEQ ID NO: 56290 - protein, 145 aa, Homo sapiens
MKVNRETKRLYVGGLSQDISEADLQNQFSRFGEVSDVEIITRKDDQGNPQKVFAYINISVAEADLKKCMSVLNKTKWKGGTLQIQLAKESFLHRLAQEREAAKAKKEESTTGNANLLEKTGGVDFHMKAVPGTEVPGHKNWVVSK

SEQ ID NO: 56291 - protein, 1167 aa, Homo sapiens; identical to SEQ ID NO: 56289

SEQ ID NO: 56292 - protein, 86 aa, Homo sapiens
MKVNRETKRLYVGGLSQDISEADLQNQFSRFGEVSDVEIITRKDDQGNPQKVFAYINISVAEADLKKSIFHVIQRDSSDEENSSIV

SEQ ID NO: 56293 - protein, 1146 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 56294 - protein, 1007 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRWDPAKMWPF

SEQ ID NO: 56295 - protein, 699 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKEASSTKGRMVMSRGGELVMVPNVEAILEDFAVLGEGLVQTVEARSERWTV

SEQ ID NO: 56296 - protein, 200 aa, Homo sapiens
MVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 56297 - protein, 1023 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETELTDQAWLPAGVRVPLHQVPYAVKGCFRFLPPAQVTVVGSYLLGTCIRPDINVDVALTMPREILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRMGPSENVALLSHITDTEQWKGAICV

SEQ ID NO: 56298 - protein, 1094 aa, Homo sapiens
MGPAPAGEQLRGATGEPEVMEPALEGTGKEGKKASSRKRTLAEPPAKGLLQPVKLSRAELYKEPTNEELNRLRETEILFHSSLLRLQVEELLKEVRLSEKKKDRIDAFLREVNQRVVRVPSVPETEEILQDKDGLNQRYFRKRALYLAHLAHHLAQDPLFGSVCFSYTNGCHLKPSLLLRPRGKDERLVTVRLHPCPPPDFFRPCRLLPTKNNVRSAWYRGQSPAGDGSPEPPTPRYNTWVLQDTVLESHLQLLSTILSSAQGLKDGVALLKVWLRQRELDKGQGGFTGFLVSMLVVFLVSTRKIHTTMSGYQVLRSVLQFLATTDLTVNGISLCLSSDPSLPALADFHQAFSVVFLDSSGHLNLCADVTASTYHQGWSLLWLQVQHEARLSMMLLDSRADDGFHLLLMTPKPMIRAFDHVLHLRPLSRLQAACHRLKLWPELQDNGGDYVSAALGPLTTLLEQGLGARLNLLAHSRPPVPEWDISQDPPKHKDSGTLTLGLLLRPEGLTSVLELGPEADQPEAAKFRQFWGSRSELRRFQDGAIREAVVWEAASMSQKRLIPHQVVTHLLALHADIPETCVHYVGGPLDALIQGLKETSSTGEEALVAAVRCYDDLSRLLWGLEGLPLTVSAVQGAHPVLRYTEVFPPTPVRPAFSFYETLRERSSLLPRLDKPCPAYVEPMTVVCHLEGSGQWPQDAEAVQRVRAAFQLRLAELLTQQHGLQCRATATHTDVLKDGFVFRIRVAYQREPQILKEVQSPEGMISLRDTAASLRLERDTRQLPLLTSALHGLQQQHPAFSGVARLAKRWVRAQLLGEGFADESLDLVAAALFLHPEPFTPPSSPQVGFLRFLFLVSTFDWKNNPLFVNLNNELTVEEQVEIRSGFLAARAQLPVMVIVTPQDRKNSVWTQDGPSAQILQQLVVLAAEALPMLEKQLMDPRGPGDIRTVFRPPLDIYDVLIRLSPRHIPRHRQAVDSPAASFCRGLLSQPGPSSLMPVLGYDPPQLYLTQLREAFGDLALFFYDQHGGEVIGVLWKPTSFQPQPFKASSTKGRMVMSRGGELVMVPNVEAILEDFAVLGEGLVQTVEARSERWTV

SEQ ID NO: 56299 - protein, 702 aa, Homo sapiens [sequence omitted]

SEQ ID NO: 56300 - protein, 214 aa, Homo sapiens
MNLSSASSTEEKAVTTVLWGCELSQERRTWTFRPQLEGKQSCRLLLHTICLGEKAKEEMHRVEILPPANQEDKKMQPVTIASLQASVLPMVSMVGVQLSPPVTFQLRAGSGPVFLSGQERYEASDLTWEEEEEEEGEEEEEEEEDDEDEDADISLEEQSPVKQVKRLVPQKQASVAKKKKLEKEEEEIRASVRDKSPVKKAKATARAKKPGFKK

SEQ ID NO: 56301 - protein, 136 aa, Homo sapiens
MNLSSASSTEEKAVTTVLWGCELSQERRTWTFRPQLEGKQSCRLLLHTICLGEKAKEEMHRVEILPPANQEDKKMQPVTIASLQASVLPMVSMVGVQLSPPVTFQLRAGSGPVFLSGQERYEKKAGKRRRGNKSQR

SEQ ID NO: 56302 - protein, 214 aa, Homo sapiens; identical to SEQ ID NO: 56300

SEQ ID NO: 56303 - protein, 214 aa, Homo sapiens; identical to SEQ ID NO: 56300

SEQ ID NO: 56304 - protein, 214 aa, Homo sapiens; identical to SEQ ID NO: 56300

SEQ ID NO: 56305 - protein, 178 aa, Homo sapiens
MAAGTAAALAFLSQESRTRAGGVGGLRVPAPVTMDSFFFGCELSGHTRSFTFKVEEEDDAEHVLALTMLCLTEGAKDECNVVEVVARNHDHQEIAVPVANLKLSCQPMLSLDDFQLQPPVTFRLKSGSGPVRITGRHQIVTMSNDVSEEESEEEEEDSDEEEVELCPILPAKKQGGRP

SEQ ID NO: 56306 - protein, 925 aa, Homo sapiens
MDRSGFGEISSPVIREAEVTRTARKQSAQKRVLLQASQDENFGNTTPRNQVIPRTPSSFRQPFTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 56307 - protein, 686 aa, Homo sapiens
MSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 56308 - protein, 896 aa, Homo sapiens
MKILVILHQETRLSLELLAHFDSLVLSTNLLFIVTPTSRSLLRQPDISCILGTGGKSPRLTQSSGFFGNLSMVTNLDDSNWAAAFSSQRSGLFTNTEPHSITEDVTISAVMLREDDPGEAASMSMFSDFLQSFLKHSSSTVFDLVEEYENICGSQVNILSKIVSRATPGLQKFSKTASMLWLLQQEMVTWRLLASLYRDRIQSALEEESVFAVTAVNASEKTVVEALFQRDSLVRQSQLVVDWLESIAKDEIGEFSDNIEFYAKSVYWENTLHTLKQRQLTSYVGSVRPLVTELDPDAPIRQKMPLDDLDREDEVRLLKYLFTLIRAGMTEEAQRLCKRCGQAWRAATLEGWKLYHDPNVNGGTELEPVEGNPYRRIWKISCWRMAEDELFNRYERAIYAALSGNLKQLLPVCDTWEDTVWAYFRVMVDSLVEQEIQTSVATLDETEELPREYLGANWTLEKVFEELQATDKKRVLEENQEHYHIVQKFLILGDIDGLMDEFSKWLSKSRNNLPGHLLRFMTHLILFFRTLGLQTKEEVSIEVLKTYIQLLIREKHTNLIAFYTCHLPQDLAVAQYALFLESVTEFEQRHHCLELAKEADLDVATITKTVVENIRKKDNGEFSHHDLAPALDTGTTEEDRLKIDVIDWLVFDPAQRAEALKQGNAIMRKFLASKKHEAAKEVFVKIPQDSIAEIYNQCEEQGMESPLPAEDDNAIREHLCIRAYLEAHETFNEWFKHMNSVPQKPALIPQPTFTEKVAHEHKEKKYEMDFGIWKGHLDALTADVKEKMYNVLLFVDGGWMVDVREDAKEDHERTHQMVLLRKLCLPMLCFLLHTILHSTGQYQECLQLADMVSSERHKLYLVFSKEELRKLLQKLRESSLMLLDQGLDPLGYEIQL

SEQ ID NO: 56309 - protein, 1156 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 56310 - protein, 224 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQVHKETKSG

SEQ ID NO: 56311 - protein, 1068 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSINVNFC

SEQ ID NO: 56312 - protein, 1085 aa, Homo sapiens
MFPAAPSPRTPGTGSRRGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 56313 - protein, 1140 aa, Homo sapiens
MGPLAGLGPGSTPRTASRKGLPLGSAVSSPVLFSPVGRRSSLSSRGTPTRMFPHHSITESVNYDVKTFGSSLPVKVMEALTLAEVDDQLTINIDEGGWACLVCKEKLIIWKIALSPITKLSVCKELQLPPSDFHWSADLVALSYSSPSGEAHSTQAVAVMVATREGSIRYWPSLAGEDTYTEAFVDSGGDKTYSFLTAVQGGSFILSSSGSQLIRLIPESSGKIHQHILPQGQGMLSGIGRKVSSLFGILSPSSDLTLSSVLWDRERSSFYSLTSSNISKWELDDSSEKHAYSWDINRALKENITDAIWGSESNYEAIKEGVNIRYLDLKQNCDGLVILAAAWHSADNPCLIYYSLITIEDNGCQMSDAVTVEVTQYNPPFQSEDLILCQLTVPNFSNQTAYLYNESAVYVCSTGTGKFSLPQEKIVFNAQGDSVLGAGACGGVPIIFSRNSGLVSITSRENVSILAEDLEGSLASSVAGPNSESMIFETTTKNETIAQEDKIKLLKAAFLQYCRKDLGHAQMVVDELFSSHSDLDSDSELDRAVTQISVDLMDDYPASDPRWAESVPEEAPGFSNTSLIILHQLEDKMKAHSFLMDFIHQVGLFGRLGSFPVRGTPMATRLLLCEHAEKLSAAIVLKNHHSRLSDLVNTAILIALNKREYEIPSNLTPADVFFREVSQVDTICECLLEHEEQVLRDAPMDSIEWAEVVINVNNILKDMLQAASHYRQNRNSLYRREESLEKEPEYVPWTATSGPGGIRTVIIRQHEIVLKVAYPQADSNLRNIVTEQLVALIDCFLDGYVSQLKSVDKSSNRERYDNLEMEYLQKRSDLLSPLLSLGQYLWAASLAEKYCDFDILVQMCEQTDNQSRLQRYMTQFADQNFSDFLFRWYLEKGKRGKLLSQPISQHGQLANFLQAHEHLSWLHEINSQELEKAHATLLGLANMETRYFAKKKTLLGLSKLAALASDFSEDMLQEKIEEMAEQERFLLHQETLPEQLLAEKQLNLSAMPVLTAPQLIGLYICEENRRANEYDFKKALDLLEYIDEEEDININDLKLEILCKALQRDNWSSSDGKDDPIEVSKDSIFVKILQKLLKDGIQLSEYLPEVKDLLQADQLGSLKSNPYFEFVLKANYEYYVQGQI

SEQ ID NO: 56314 - protein, 1475 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERTRFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPASSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 56315 - protein, 1455 aa, Homo sapiens
GLRLCLSRPLTRPGAGSGGGSAMASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERTRFVASKPLEEEEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPASSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 56316 - protein, 1506 aa, Homo sapiens
MASGAGGVGGGGGGKIRTRRCHQGPIKPYQQGRQQHQGILSRVTESVKNIVPGWLQRYFNKNEDVCSCSTDTSEVPRWPENKEDHLVYADEESSNITDGRITPEPAVSNTEEPSTTSTASNYPDVLTRPSLHRSHLNFSMLESPALHCQPSTSSAFPIGSSGFSLVKEIKDSTSQHDDDNISTTSGFSSRASDKDITVSKNTSLPPLWSPEAERSHSLSQHTATSSKKPAFNLSAFGTLSPSLGNSSILKTSQLGDSPFYPGKTTYGGAAAAVRQSKLRNTPYQAPVRRQMKAKQLSAQSYGVTSSTARRILQSLEKMSSPLADAKRIPSIVSSPLNSPLDRSGIDITDFQAKREKVDSQYPPVQRLMTPKPVSIATNRSVYFKPSLTPSGEFRKTNQRIDNKCSTGYEKNMTPGQNREQRESGFSYPNFSLPAANGLSSGVGGGGGKMRRERTRFVASKPLEEERQGLTVLPKLISSSCAQAIIPSWPLKVLRLQEMEVPVLPKISLPITSSSLPTFNFSSPEITTSSPSPINSSQALTNKVQMTSPSSTGSPMFKFSSPIVKSTEANVLPPSSIGFTFSVPVAKTAELSGSSSTLEPIISSSAHHVTTVNSTNCKKTPPEDCEGPFRPAEILKEGSVLDILKSPGFASPKIDSVAAQPTATSPVVYTRPAISSFSSSGIGFGESLKAGSSWQCDTCLLQNKVTDNKCIACQAAKLSPRDTAKQTGIETPNKSGKTTLSASGTGFGDKFKPVIGTWDCDTCLVQNKPEAIKCVACETPKPGTCVKRALTLTVVSESAETMTASSSSCTVTTGTLGFGDKFKRPIGSWECSVCCVSNNAEDNKCVSCMSEKPGSSVPASSSSTVPVSLPSGGSLGLEKFKKPEGSWDCELCLVQNKADSTKCLACESAKPGTKSGFKGFDTSSSSSNSAASSSFKFGVSSSSSGPSQTLTSTGNFKFGDQGGFKIGVSSDSGSINPMSEGFKFSKPIGDFKFGVSSESKPEEVKKDSKNDNFKFGLSSGLSNPVSLTPFQFGVSNLGQEEKKEELPKSSSAGFSFGTGVINSTPAPANTIVTSENKSSFNLGTIETKSASVAPFTCKTSEAKKEEMPATKGGFSFGNVEPASLPSASVFVLGRTEEKQQEPVTSTSLVFGKKADNEEPKCQPVFSFGNSEQTKDENSSKSTFSFSMTKPSEKESEQPAKATFAFGAQTSTTADQGAAKPVFSFLNNSSSSSSTPATSAGGGIFGSSTSSSNPPVATFVFGQSSNPVSSSAFGNTAESSTSQSLLFSQDSKLATTSSTGTAVTPFVFGPGASSNNTTTSGFGFGATTTSSSAGSSFVFGTGPSAPSASPAFGANQTPTFGQSQGASQPNPPGFGSISSSTALFPTGSQPAPPTFGTVSSSSQPPVFGQQPSQSAFGSGTTPNSSSAFQFGSSTTNFNFTNNSPSGVFTFGANSSTPAASAQPSGSGGFPFNQSPAAFTVGSNGKNVFSSSGTSFSGRKIKTAVRRRK

SEQ ID NO: 56317 - protein, 1391 aa, Homo sapiens
MPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 56318 - protein, 1332 aa, Homo sapiens
MSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 56319 - protein, 1353 aa, Homo sapiens
MYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKELQEQLKITTFKDLVIRDKELTGALIASLINCYIRDNAAVDGISLHLQDICPLLYSTDDAICSKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 56320 - protein, 1327 aa, Homo sapiens
MPSSLLGAAMPASTSAAALQEALENAGRLIDRQLQEDRMYPDLSELLMVSAPNNPTVSGMSDMDYPLQGPGLLSVPNLPEISSIRRVPLPPELVEQFGHMQCNCMMGVFPPISRAWLTIDSDIFMWNYEDGGDLAYFDGLSETILAVGLVKPKAGIFQPHVRHLLVLATPVDIVILGLSYANLQTGSGVLNDSLSGGMQLLPDPLYSLPTDNTYLLTITSTDNGRIFLAGKDGCLYEVAYQAEAGWFSQRCRKINHSKSSLSFLVPSLLQFTFSEDDPILQIAIDNSRNILYTRSEKGVIQVYDLGQDGQGMSRVASVSQNAIVSAAGNIARTIDRSVFKPIVQIAVIENSESLDCQLLAVTHAGVRLYFSTCPFRQPLARPNTLTLVHVRLPPGFSASSTVEKPSKVHRALYSKGILLMAASENEDNDILWCVNHDTFPFQKPMMETQMTAGVDGHSWALSAIDELKVDKIITPLNKDHIPITDSPVVVQQHMLPPKKFVLLSAQGSLMFHKLRPVDQLRHLLVSNVGGDGEEIERFFKLHQEDQACATCLILACSTAACDREVSAWATRAFFRYGGEAQMRFPTTLPPPSNVGPILGSPVYSSSPVPSGSPYPNPSFLGTPSHGIQPPAMSTPVCALGNPATQATNMSCVTGPEIVYSGKHNGICIYFSRIMGNIWDASLVVERIFKSGNREITAIESSVPCQLLESVLQELKGLQEFLDRNSQFAGGPLGNPNTTAKVQQRLIGFMRPENGNPQQMQQELQRKFHEAQLSEKISLQAIQQLVRKSYQALALWKLLCEHQFTIIVAELQKANELLQRSRQVQNKTEKERMLRESLKEYQKISNQVDLSNVCAQYRQVRFYEGVVELSLTAAEKKDPQGLGLHFYKHGEPEEDIVGLQAFQERLNSYKCITDTLQELVNQSKAAPQSPSVPKKPGPPVLSSDPNMLSNEEAGHHFEQMLKLSQRSKDELFSIALYNWLIQVDLADKLLQVASPFLEPHLVRMAKVDQNRVRYMDLLWRYYEKNRSFSNAARVLSRLADMHSTEISLQQRLEYIARAILSAKSSTAISSIAADGEFLHELEEKMEVARIQLQIQETLQRQYSHHSSVQDAVSQLDSELMDITKLYGEFADPFKLAECKLAIIHCAGYSDPILVQTLWQDIIEKELSDSVTLSSSDRMHALSLKIVLLGKIYAGTPRFFPLDFIVQFLEQQVCTLNWDVGFVIQTMNEIGVPLPRLLEVYDQLFKSRDPFWNRMKKPLHLLDCIHVLLIRYVENPSQVLNCERRRFTNLCLDAVCGYLVELQSMSSSVAVQAITGNFKSLQAKLERLH

SEQ ID NO: 56321 - protein, 1436 aa, Homo sapiens
MLHLSAAPPAPPPEVTATARPCLCSVGRRGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSELVVDSQMQSIFTDIGKVDFTDPCNYQLIPAVPGISPNSTASTAWLSSDGEALFALPCASGGIFVLKLPPYDIPGMVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNPAQPLNIRMNLTQLYGSNTAGYIVCRGVHKIASTRFLICRDLLILQQLLMRLGDAVIWGTGQLFQAQQDLLHRTAPLLLSYYLIKWGSECLATDVPLDTLESNLQHLSVLELTDSGALMANRFVSSPQTIVELFFQEVARKHIISHLFSQPKAPLSQTGLNWPEMITAITSYLLQLLWPSNPGCLFLECLMGNCQYVQLQDYIQLLHPWCQVNVGSCRFMLGRCYLVTGEGQKALECFCQAASEVGKEEFLDRLIRSEDGEIVSTPRLQYYDKVLRLLDVIGLPELVIQLATSAITEAGDDWKSQATLRTCIFKHHLDLGHNSQAYEALTQIPDSSRQLDCLRQLVVVLCERSQLQDLVEFPYVNLHNEVVGIIESRARAVDLMTHNYYELLYAFHIYRHNYRKAGTVMFEYGMRLGREVRTLRGLEKQGNCYLAALNCLRLIRPEYAWIVQPVSGAVYDRPGASPKRNHDGECTAAPTNRQIEILELEDLEKECSLARIRLTLAQHDPSAVAVAGSSSAEEMVTLLVQAGLFDTAISLCQTFKLPLTPVFEGLAFKCIKLQFGGEAAQAEAWAWLAANQLSSVITTKESSATDEAWRLLSTYLERYKVQNNLYHHCVINKLLSHGVPLPNWLINSYKKVDAAELLRLYLNYDLLEEAVDLVSEYVDAVLGKGHQYFGIEFPLSATAPMVWLPYSSIDQLLQALGENSANSHNIALSQKILDKLEDYQQKVDKATRDLLYRRTL

SEQ ID NO: 56322 - protein, 483 aa, Homo sapiens
MVSVVELKQSSVMQRLLTGWMPTAIRGDQSPSDRPLSLAVHCVEHDAFIFALCQDHKLRMWSYKEQMCLMVADMLEYVPVKKDLRLTAGTGHKLRLAYSPTMGLYLGIYMHAPKRGQRRGFAMLPGLKLLSSSSPPTSASQCAGITSVNHSTQPEFFFCIFQLVSTESNRYSLDHISSLFTSQETLIDFALTSTDIWALWHDAENQTVVKYINFEHNVAGQWNPVFMQPLPEEEIVIRDDQDPREMYLQSLFTPGQFTNEALCKALQIFCRGTERNLDLSWSELKKEVTLAVENELQGSVTEYEFSQEEFRNLQQEFWCKFYACCLQYQEALSHPLALHLNPHTNMVCLLKKGYLSFLIPSSLVDHLYLLPYENLLTEDETTISDDVDIARDVICLIKCLRLIEESVTVDMSVIMEMSCYNLQSPEKAAEQILEDMITIDVENVMEDICSKLQEIRNPIHAIGLLIREMDYETEVEMEKGFNP

SEQ ID NO: 56323 - protein, 224 aa, Homo sapiens
MLHLSAAPPAPPPEVTATARPCLCSVGRRGDGGKMAAAGALERSFVELSGAERERPRHFREFTVCSIGTANAVAGAVKYSESAGGFYYVESGKLFSVTRNRFIHWKTSGDTLELMEESLDINLLNNAIRLKFQNCSVLPGGVYVSETQNRVIILMLTNQTVHRLLLPHPSRMYRSVSWLSAISFISQITLGVTNVVLERCLLELKEIWILVIPHQAYFDSYRLK

SEQ ID NO: 56324 - protein, 2012 aa, Homo sapiens
MATPLAVNSAASLWGPYKDIWHKVGNALWRRQPEAVHLLDKILKKHKPDFISLFKNPPKNVQQHEKVQKASTEGVAIQGQQGTRLLPEQLIKEAFILSDLFDIGELAAVELLLAGEHQQPHFPGLTRGLVAVLLYWDGKRCIANSLKALIQSRRGKTWTLELSPELASMTTRFTDELMEQGLTYKVLTLVSQIDVNNEFEKLQRERGLGSEKHRKEVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLIGELYKKNPFHLELALEYWCPTEPLQTPTIMGSYLGVAHQRPPQRQVVLSKFVRQMGDLLPPTIYIPYLKMLQGLANGPQCAHYCFSLLKVNGSSHVENIQGAGGSPVSWEHFFHSLMLYHEHLRKDLPSADSVQYRHLPSRGITQKEQDGLIAFLQLTSTIITWSENARLALCEHPQWTPVVVILGLLQCSIPPVLKAELLKTLAAFGKSPEIAASLWQSLEYTQILQTVRIPSQRQAIGIEVELNEIESRCEEYPLTRAFCQLISTLVESSFPSNLGAGLRPPGFDPYLQFLRDSVFLRFRTRAYRRAAEKWEVAEVVLEVFYKLLRDYEPQLEDFVDQFVELQGEEIIAYKPPGFSLMYHLLNESPMLELALSLLEEGVKQLDTYAPFPGKKHLEKAVQHCLALLNLTLQKENLFMDLLRESQLALIVCPLEQLLQGINPRTKKADNVVNIARYLYHGNTNPELAFESAKILCCISCNSNIQIKLVGDFTHDQSISQKLMAGFVECLDCEDAEEFVRLEEGSELEKKLVAIRHETRIHILNLLITSLECNPPNLALYLLGFELKKPVSTTNLQDPGVLGCPRTCLHAILNILEKGTEGRTGPVAVRESPQLAELCYQVIYQLCACSDTSGPTMRYLRTSQDFLFSQLQYLPFSNKEYEISMLNQMSWLMKTASIELRVTSLNRQRSHTQRLLHLLLDDMPVKPYSDGEGGIEDENRSVSGFLHFDTATKVRRKILNILDSIDFSQEIPEPLQLDFFDRAQIEQVIANCEHKNLRGQTVCNVKLLHRVLVAEVNALQGMAAIGQRPLLMEEISTVLQYVVGRNKLLQCLHAKRHALESWRQLVEIILTACPQDLIQAEDRQLIIRDILQDVHDKILDDEAAQELMPVVAGAVFTLTAHLSQAVLTEQKETSVLGPAEAHYAFMLDSCFTSPPPEENPLVGFASIGDSSLYIILKKLLDFILKTGGGFQRVRTHLYGSLLYYLQIAQRPDEPDTLEAAKKTMWERLTAPEDVFSKLQRENIAIIESYGAALMEVVCRDACDGHEIGRMLALALLDRIVSVDKQQQWLLYLSNSGYLKVLVDSLVEDDRTLQSLLTPQPPLLKALYTYESKMAFLTRVAKIQQGALELLRSGVIVRLAQCQVYDMRPETDPQSMFGMRDPPMFIPTPVDRYRQILLPALQLCQVILTSSMAQHLQAAGQVLQFLISHSDTIQAILRCQDVSAGSLQELALLTGIISKAALPGILSELDVDVNEGSLMELQGHIGRFQRQCLGLLSRFGGSDRLRQFKFQDDNVEGDKVSKKDEIELAMQQICANVMEYCQSLMLQSSPTFQHAVCLFTPSLSETVNRDGPRQDTQAPVVPYWRLPGLGIIIYLLKQSANDFFSYYDSHRQSVSKLQNVEQLPPDEIKELCQSVMPAGVDKISTAQKYVLARRRLVKVINNRAKLLSLCSFIIETCLFILWRHLEYYLLHCMPTDSQDSLFASRTLFKSRRLQDSFASETNLDFRSGLAIVSQHDLDQLQADAINAFGESLQKKLLDIEGLYSKVRSRYSFIQALVRRIRGLLRISRN

SEQ ID NO: 56325 - protein, 249 aa, Homo sapiens
MSLRNYSEREVSDLIKECRQSLAESLFAWACQSPLGKEDTLLLIGHLERVTVEANGSLDAVNLALLMALLYCFDISFIEQSTEERDDMIHQLPLLTEKQYIATIHSRLQDSQLWKLPGLQATVRLAWALALRGISQLPDVTALAEFTEADEAMAELAIADNVFLFLMESVVVSEYFYQEEFYIRRVHNLITDFLALMPMKVKQLRNRADEDARMIHMSMQMGNEPPISLRRDLEHLMLLVSKLLVLRLN

SEQ ID NO: 56326 - protein, 1887 aa, Homo sapiens
MAARGRGLLLLTLSVLLAAGPSAAAAKLNIPKVLLPFTRATRVNFTLEASEGCYRWLSTRPEVASIEPLGLDEQQCSQKAVVQARLTQPARLTSIIFAEDITTGQVLRCDAIVDLIHDIQIVSTTRELYLEDSPLELKIQALDSEGNTFSTLAGLVFEWTIVKDSEADRFSDSHNALRILTFLESTYIPPSYISEMEKAAKQGDTILVSGMKTGSSKLKARIQEAVYKNVRPAEVRLLILENILLNPAYDVYLMVGTSIHYKVQKIRQGKITELSMPSDQYELQLQNSIPGPEGDPARPVAVLAQDTSMVTALQLGQSSLVLGHRSIRMQGASRLPNSTIYVVEPGYLGFTVHPGDRWVLETGRLYEITIEVFDKFSNKVYVSDNIRIETVLPAEFFEVLSSSQNGSYHRIRALKRGQTAIDAALTSVVDQDGGVHILQVPVWNQQEVEIHIPITLYPSILTFPWQPKTGAYQYTIRAHGGSGNFSWSSSSHLVATVTVKGVMTTGSDIGFSVIQAHDVQNPLHFGEMKVYVIEPHSMEFAPCQVEARVGQALELPLRISGLMPGGASEVVTLSDCSHFDLAVEVENQGVFQPLPGRLPPGSEHCSGIRVKAEAQGSTTLLVSYRHGHVHLSAKITIAAYLPLKAVDPSSVALVTLGSSKEMLFEGGPRPWILEPSKFFQNVTAEDTDSIGLALFAPHSSRNYQQHWILVTCQALGEQVIALSVGNKPSLTNPFPAVEPAVVKFVCAPPSRLTLAPVYTSPQLDMSCPLLQQNKQVVPVSSHRNPRLDLAAYDQEGRRFDNFSSLSIQWESTRPVLASIEPELPMQLVSQDDESGQKKLHGLQAILVHEASGTTAITATATGYQESHLSSARTKQPHDPLVPLSASIELILVEDVRVSPEEVTIYNHPGIQAELRIREGSGYFFLNTSTADVVKVAYQEARGVAMVHPLLPGSSTIMIHDLCLVFPAPAKAVVYVSDIQELYIRVVDKVEIGKTVKAYVRVLDLHKKPFLAKYFPFMDLKLRAASPIITLVALDEALDNYTITFLIRGVAIGQTSLTASVTNKAGQRINSAPQQIEVFPPFRLMPRKVTLLIGATMQVTSEGGPQPQSNILFSISNESVALVSAAGLVQGLAIGNGTVSGLVQAVDAETGKVVIISQDLVQVEVLLLRAVRIRAPIMRMRTGTQMPIYVTGITNHQNPFSFGNAVPGLTFHWSVTKRDVLDLRGRHHEASIRLPSQYNFAMNVLGRVKGRTGLRVVVKAVDPTSGQLYGLARELSDEIQVQVFEKLQLLNPEIEAEQILMSPNSYIKLQTNRDGAASLSYRVLDGPEKVPVVHVDEKGFLASGSMIGTSTIEVIAQEPFGANQTIIVAVKVSPVSYLRVSMSPVLHTQNKEALVAVPLGMTVTFTVHFHDNSGDVFHAHSSVLNFATNRDDFVQIGKGPTNNTCVVRTVSVGLTLLRVWDAEHPGLSDFMPLPVLQAISPELSGAMVVGDVLCLATVLTSLEGLSGTWSSSANSILHIDPKTGVAVARAVGSVTVYYEVAGHLRTYKEVVVSVPQRIMARHLHPIQTSFQEATASKVIVAVGDRSSNLRGECTPTQREVIQALHPETLISCQSQFKPAVFDFPSQDVFTVEPQFDTALGQYFCSITMHRLTDKQRKHLSMKKTALVVSASLSSSHFSTEQVGAEVPFSPGLFADQAEILLSNHYTSSEIRVFGAPEVLENLEVKSGSPAVLAFAKEKSFGWPSFITYTVGVLDPAAGSQGPLSTTLTFSSPVTNQAIAIPVTVAFVVDRRGPGPYGASLFQHFLDSYQVMFFTLFALLAGTAVMIIAYHTVCTPRDLAVPAALTPRASPGHSPHYFAASSPTSPNALPPARKASPPSGLWSPAYASH

SEQ ID NO: 56327 - protein, 2090 aa, Homo sapiens
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 56328 - protein, 2080 aa, Homo sapiens
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSENSSQSAPPMSPFSSASKPAASGPLSHPTPLSAPPSSVPLKSSVLPSPSAGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 56329 - protein, 1519 aa, Homo sapiens
MKPSFPPSTSAVKVNLSEKFTAAATSTPVSSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 56330 - protein, 2091 aa, Homo sapiens
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSEKFTAAATSTPVSSSQSAPPMSPFSSASKPAASGPLSHPTPLSAPPSSVPLKSSVLPSPSAGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 56331 - protein, 78 aa, Homo sapiens
GEGTAAASAGGFGFGSSSNTTSFGTLASQNAPTFGSLSQQTSGFGTQSSGFSGFGSGTGGFSFGSNNSSVQGFGGWRS

SEQ ID NO: 56332 - protein, 1684 aa, Homo sapiens
GAEGRKFAVERPGFRGQGRGRQRWLLRHTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSEKFTAAATSTPVSSSQSAPPMSPFSSASKPAASGPLSHPTPLSAPPSSVPLKSSVLPSPSAGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAMGSSVPYSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGFGSSSNTTSFGTLASQNAPTFGSLSQQTSGFGTQSSGFSGFGSGTGGFSFGSNNSSVQGFGGWRS

SEQ ID NO: 56333 - protein, 2093 aa, Homo sapiens
MGDEMDAMIPEREMKDFQFRALKKVRIFDSPEELPKERSSLLAVSNKYGLVFAGGASGLQIFPTKNLLIQNKPGDDPNKIVDKVQGLLVPMKFPIHHLALSCDNLTLSACMMSSEYGSIIAFFDVRTFSNEAKQQKRPFAYHKLLKDAGGMVIDMKWNPTVPSMVAVCLADGSIAVLQVTETVKVCATLPSTVAVTSVCWSPKGKQLAVGKQNGTVVQYLPTLQEKKVIPCPPFYESDHPVRVLDVLWIGTYVFAIVYAAADGTLETSPDVVMALLPKKEEKHPEIFVNFMEPCYGSCTERQHHYYLSYIEEWDLVLAASAASTEVSILARQSDQINWESWLLEDSSRAELPVTDKSDDSLPMGVVVDYTNQVEITISDEKTLPPAPVLMLLSTDGVLCPFYMINQNPGVKSLIKTPERLSLEGERQPKSPGSTPTTPTSSQAPQKLDASAAAAPASLPPSSPAAPIATFSLLPAGGAPTVFSFGSSSLKSSATVTGEPPSYSSGSDSSKAAPGPGPSTFSFVPPSKASLAPTPAASPVAPSAASFSFGSSGFKPTLESTPVPSVSAPNIAMKPSFPPSTSAVKVNLSENSSQSAPPMSPFSSASKPAASGPLSHPTPLSAPPSSVPLKSSVLPSPSGRSAQGSSSPVPSMVQKSPRITPPAAKPGSPQAKSLQPAVAEKQGHQWKDSDPVMAGIGEEIAHFQKELEELKARTSKACFQVGTSEEMKMLRTESDDLHTFLLEIKETTESLHGDISSLKTTLLEGFAGVEEAREQNERNRDSGYLHLLYKRPLDPKSEAQLQEIRRLHQYVKFAVQDVNDVLDLEWDQHLEQKKKQRHLLVPERETLFNTLANNREIINQQRKRLNHLVDSLQQLRLYKQTSLWSLSSAVPSQSSIHSFDSDLESLCNALLKTTIESHTKSLPKVPAKLSPMKQAQLRNFLAKRKTPPVRSTAPASLSRSAFLSQRYYEDLDEVSSTSSVSQSLESEDARTSCKDDEAVVQAPRHAPVVRTPSIQPSLLPHAAPFAKSHLVHGSSPGVMGTSVATSASKIIPQGADSTMLATKTVKHGAPSPSHPISAPQAAAAAALRRQMASQAPAVNTLTESTLKNVPQVVNVQELKNNPATPSTAKTPHPVLTPVAANQAKQGSLINSLKPSGPTPASGQLSSGDKASGTAKIETAVTSTPSASGQFSKPFSFSPSGTGFNFGIITPTPSSNFTAAQGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFNQLTNNTATAPSATPVFGQVAASTAPSLFGQQTGSTASTAAATPQVSSSGFSSPAFGTTAPGVFGQTTFGQASVFGQSASSAASVFSFSQPGFSSVPAFGQPASSTPTSTSGSVFGAASSTSSSSSFSFGQSSPNTGGGLFGQSNAPAFGQSPGFGQGGSVFGGTSAATTTAATSGFSFCQASGFGSSNTGSVFGQAASTGGIVFGQQSSSSSGSVFGSGNTGRGGGFFSGLGGKPSQDAANKNPFSSASGGFGSTATSNTSNLFGNSGAKTFGGFASSSFGEQKPTGTFSSGGGSVASQGFGFSSPNKTGGFGAAPVFGSPPTFGGSPGFGGVPAFGSAPAFTSPLGSTGGKVFGEGTAAASAGGFGSLAMSLSPTLKGRLLLMRPKAGGGREQAAPGRKSNESRSLGHLCMERALTSPLKVWEQQQHHILRHARESECPHFRITVPTDFWFWDPE

SEQ ID NO: 56334 - protein, 435 aa, Homo sapiens
MKSSLLLRGVHFCFHLPGATPSTKESSQPDAFSSGGGSKPSYEAIPESSPPSGITSASNTTPGEPAASSSRPVAPSGTALSTTSSKLETPPSKLGELLFPSSLAGETLGSFSGLRVGQADDSTKPTNKASSTSLTSTQPTKTSGVPSGFNFTAPPVLGKHTEPPVTSSATTTSVAPPAATSTSSTAVFGSLPVTSAGSSGVISFGGTSLSAGKTSFSFGSQQTNSTVPPSAPPPTTAATPLPTSFPTLSFGSLLSSATTPSLPMSAGRSTEEATSSALPEKPGDSEVSASAASLLEEQQSAQLPQAPPQTSDSVKKEPVLAQPAVSNSGTAASSTSLVALSAEATPATTGVPDARTEAVPPASSFSVPGQTAVTAAAISSAGPVAVETSSTPIASSTTSIVAPGPSAEAAAFGTVTSGSSVFAQPPAASSSSAFN

SEQ ID NO: 56335 - protein, 326 aa, Homo sapiens
MAAFAVEPQGPALGSEPMMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGQSMFSPASIGQPRKTTLSPAQLDPFYTQGDSLTSEDHLDDSWVTVFGFPQASASYILLQFAQYGNILKHVMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 56336 - protein, 309 aa, Homo sapiens
MMLGSPTSPKPGVNAQFLPGFLMGDLPAPVTPQPRSISGPSVGVMEMRSPLLAGGSPPQPVVPAHKDKSGAPPVRSIYDDISSPGLGSTPLTSRRQPNISVMQSPLVGVTSTPGTGQSMFSPASIGQPRKTTLSPAQLDPFYTQGDSLTSEDHLDDSWVTVFGFPQASASYILLQFAQYGNILKHVMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 56337 - protein, 191 aa, Homo sapiens
MFSPASIGQPRKTTLSPAQLDPFYTQGDSLTSEDHLDDSWVTVFGFPQASASYILLQFAQYGNILKHVMSNTGNWMHIRYQSKLQARKALSKDGRIFGESIMIGVKPCIDKSVMESSDRCALSSPSLAFTPPIKTLGTPTQPGSTPRISTMRPLATAYKASTSDYQVISDRQTPKKDESLVSKAMEYMFGW

SEQ ID NO: 56338 - protein, 326 aa, Homo sapiens
MKQDASRNAAYTVDCEDYVHVVEFNPFENGDSGNLIAYGGNNYVVIGTCTFQEEEADVEGIQYKTLRTFHHGVRVDGIAWSPETRLDSLPPVIKFCTSAADMKIRLFTSDLQDKNEYKVLEGHTDFINGLVFDPKEGQEIASVSDDHTCRIWNLEGVQTAHFVLHSPGMSVCWHPEETFKLMVAEKNGTIRFYDLLAQQAILSLESEQVPLMSAHWCLKNTFKVGAVAGNDWLIWDITRSSYPQNKRPVHMDRACLFRWSTISENLFATTGYPGKMASQFQIHHLGHPQPILMGSVAVGSGLSWHRTLPLCVIGGDHKLLFWVTEV

SEQ ID NO: 56339 - protein, 51 aa, Homo sapiens
MKQDASRNAAYTVDCEDYVHVVEFNPFENGDSGNLIAYGGNNYVVIGTCTF

SEQ ID NO: 56340 - protein, 326 aa, Homo sapiens; identical to SEQ ID NO: 56338

SEQ ID NO: 56341 - protein, 380 aa, Homo sapiens
MEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIDNADSSTLHAVTFLRTPEILTVNSIGQLKIWDFRQQGNEPSQILSLTGDRVPLHCVDRHPNQQHVVATGGQDGMLSIWDVRQGTMPVSLLKAHEAEMWEVHFHPSNPEHLFTCSEDGSLWHWDASTDVPEKSSLFHQGGRSSTFLSHSISNQANVHQSVISSWLSTDPAKDRIEITSLLPSRSLSVNTLDVLGPCLVCGTDAEAIYVTRHLFS

SEQ ID NO: 56342 - protein, 248 aa, Homo sapiens
MGGPLSLGTDCAHTGYRRELTLCSHRLRPKVPSNQGSAGRGGAERRVLCLLFAVPAAAAFGMEEIYAKFVSQKISKTRWRPLPPGSLQTAETFATGSWDNEENYISLWSIGDFGNLDSDGGFEGDHQLLCDIRHHGDVMDLQFFDQERIVAASSTGCVTVFLHHPNNQTLSVNQQWTTAHYHTGPGSPSYSSAPCTGVVCNNPEIVTVGEDGRINLFRADHKEAVRTIGLVTECHSTVLIDIPTNSML

SEQ ID NO: 56343 - protein, 380 aa, Homo sapiens; identical to SEQ ID NO: 56341

SEQ ID NO: 56344 - protein, 468 aa, Homo sapiens
MAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 56345 - protein, 440 aa, Homo sapiens
MASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 56346 - protein, 440 aa, Homo sapiens; identical to SEQ ID NO: 56345

SEQ ID NO: 56347 - protein, 8 aa, Homo sapiens
MASEEVLK

SEQ ID NO: 56348 - protein, 178 aa, Homo sapiens
MAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGGDEEENDEPPKVVVTEVKEEDAFYSKKCKLFYKKDNEFKEKGIGTLHLKPTANQKTQLLVRADT

SEQ ID NO: 56349 - protein, 45 aa, Homo sapiens
MAKRNAEKELTDRNWDQEDEAEEVGTFSMASEEVLKNRAIKKAKR

SEQ ID NO: 56350 - protein, 218 aa, Homo sapiens
MEVASEKKTDPSSLGATSASFNFGKKVDSSVLGSLSSVPLTGFSFSPGNSSLFGKDTTQSKPVSSPFPTKPLEGQAEGDSGECKGGDEEENDEPPKVVVTEVKEEDAFYSKKCKLFYKKDNEFKEKGIGTLHLKPTANQKTQLLVRADTNLGNILLNVLIPPNMPCTRTGKNNVLIVCVPNPPIDEKNATMPVTMLIRVKTSEDADELHKILLEKKDA

SEQ ID NO: 56351 - protein, 76 aa, Homo sapiens
MAKRNAEKELTDRNWDQEDEAEEVGTFSMASEEVLKNRAIKKAKRRNVGFEVLLLQMALPPWLIKFQIPKLMGTVS

SEQ ID NO: 56352 - protein, 4 aa, Homo sapiens
MAKR

SEQ ID NO: 56353 - protein, 10 aa, Homo sapiens
MAKRNAEKEL

SEQ ID NO: 56354 - protein, 507 aa, Homo sapiens
MAFNFGAPSGTSGTAAATAAPAGGFGGFGTTSTTAGSAFSFSAPTNTGTTGLFGGTQNKGFGFGTGFGTTTGTSTGLGTGLGTGLGFGGFNTQQQQQTTLGGLFSQPTQAPTQSNQLINTASALSAPTLLGDERDAILAKWNQLQAFWGTGKGYFNNNIPPVEFTQENPFCRFKAVGYSCMPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDIISEDISELQKNQTTSVAKIAQYKRKLMDLSHRTLQVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 56355 - protein, 291 aa, Homo sapiens
MPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 56356 - protein, 327 aa, Homo sapiens
MPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDIISEDISELQKNQTTSVAKIAQYKRKLMDLSHRTLQVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 56357 - protein, 459 aa, Homo sapiens
MAFNFGAPSGTSGTAAATAAPAGGFGGFGTTSTTAGSAFSFSAPTNTGTTALGGLFSQPTQAPTQSNQLINTASALSAPTLLGDERDAILAKWNQLQAFWGTGKGYFNNNIPPVEFTQENPFCRFKAVGYSCMPSNKDEDGLVVLVFNKKETEIRSQQQQLVESLHKVLGGNQTLTVNVEGTKTLPDDQTEVVIYVVERSPNGTSRRVPATTLYAHFEQANIKTQLQQLGVTLSMTRTELSPAQIKQLLQNPPAGVDPIIWEQAKVDNPDSEKLIPVPMVGFKELLRRLKVQDQMTKQHQTRLDIISEDISELQKNQTTSVAKIAQYKRKLMDLSHRTLQVLIKQEIQRKSGYAIQADEEQLRVQLDTIQGELNAPTQFKGRLNELMSQIRMQNHFGAVRSEERYYIDADLLREIKQHLKQQQEGLSHLISIIKDDLEDIKLVEHGLNETIHIRGGVFS

SEQ ID NO: 56358 - protein, 193 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPA

SEQ ID NO: 56359 - protein, 522 aa, Homo sapiens
MSGFNFGGTGAPTGGFTFGTAKTATTTPATGFSFSTSGTGGFNFGAPFQPATSTPSTGLFSLATQTPATQTTGFTFGTATLASGGTGFSLGIGASKLNLSNTAATPAMANPSGFGLGSSNLTNAISSTVTSSQGTAPTGFVFGPSTTSVAPATTSGGFSFTGGSTAQPSGFNIGSAGNSAQPTAPATLPFTPATPAATTAGATQPAAPTPTATITSTGPSLFASIATAPTSSATTGLSLCTPVTTAGAPTAGTQGFSLKAPGAASGTSTTTSTAATATATTTSSSSTTGFALNLKPLAPAGIPSNTAAAVTAPPGPGAAAGAAASSAMTYAQLESLINKWSLELEDQERHFLQQATQVNAWDRTLIENGEKITSLHREVEKVKLDQKRLDQELDFILSQQKELEDLLSPLEELVKEQSGTIYLQHADEEREKTYKLAENIDAQLKRMAQDLKDIIEHLNTSGAPADTSDPLQQICKILNAHMDSLQWIDQNSALLQRKVEEVTKVCEGRRKEQERSFRITFD

SEQ ID NO: 56360 - protein, 522 aa, Homo sapiens; identical to SEQ ID NO: 56359

SEQ ID NO: 56361 - protein, 522 aa, Homo sapiens; identical to SEQ ID NO: 56359

SEQ ID NO: 56362 - protein, 656 aa, Homo sapiens
MEELDGEPTVTLIPGVNSKKNQMYFDWGPGEMLVCETSFNKKEKSEMVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 56363 - protein, 462 aa, Homo sapiens
MAASSAARSPFCQQWSSSGTCVRFFLLKWPQVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVKVAAAVVFFACQSLLELSCIAVADVRVSSFVVLPVRVYSP

SEQ ID NO: 56364 - protein, 324 aa, Homo sapiens
MVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECRDVHLK

SEQ ID NO: 56365 - protein, 259 aa, Homo sapiens
MREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 56366 - protein, 610 aa, Homo sapiens
MVPSCPFIYIIRKDVDVYSQILRKLFNESHGIFLGLQRIDEELTGKSRKSQLVRVSKNYRSVIRACMEEMHQVAIAAKDPANGRQFSSQVSILSAMELIWNLCEILFIEVAPAGPLLLHLLDWVRLHVCEVDSLSADVLGSENPSKHDSFWNLVTILVLQGRLDEARQMLSKEADASPASAGICRIMGDLMRTMPILSPGNTQTLTELELKWQHWHEECERYLQDSTFATSPHLESLLKIMLGDEAALLEQKELLSNWYHFLVTRLLYSNPTVKPIDLHYYAQSSLDLFLGGESSPEPLDNILLAAFEFDIHQVIKECSIALSNWWFVAHLTDLLDHCKLLQSHNLYFGSNMREFLLLEYASGLFAHPSLWQLGVDYFDYCPELGRVSLELHIERIPLNTEQKALKVLRICEQRQMTEQVRSICKILAMKAVRNNRLGSALSWSIRAKDAAFATLVSDRFLRDYCERGCFSDLDLIDNLGPAMMLSDRLTFLGKYREFHRMYGEKRFADAASLLLSLMTSRIAPRSFWMTLLTDALPLLEQKQVIFSAEQTYELMRCLEDLTSRRPVHGESDTEQLQDDDIETTKVEMLRLSLARNLARAIIREGSLEGS

SEQ ID NO: 56367 - protein, 741 aa, Homo sapiens
MAAAEGPVGDGELWQTWLPNHVVFLRLREGLKNQSPTEAEKPASSSLPSSPPPQLLTRNVVFGLGGELFLWDGEDSSFLVVRLRGPSGGGEEPALSQYQRLLCINPPLFEIYQVLLSPTQHHVALIGIKGLMVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLKASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 56368 - protein, 626 aa, Homo sapiens
MVLELPKRWGKNSEFEGGKSTVNCSTTPVAERFFTSSTSLTLKHAAWYPSEILDPHVVLLTSDNVIRIYSLREPQTPTNVIILSEAEEESLVLNKGRAYTASLGETAVAFDFGPLAAVPKTLFGQNGKDEVVAYPLYILYENGETFLTYISLLHSPGNIGKLLGPLPMHPAAEDNYGYDACAVLCLPCVPNILVIATESGMLYHCVVLEGEEEDDHTSEKSWDSRIDLIPSLYVFECVELELALKLASGEDDPFDSDFSCPVKLHRDPKCPSRYHCTHEAGVHSVGLTWIHKLHKFLGSDEEDKDSLQELSTEQKCFVEHILCTKPLPCRQPAPIRGFWIVPDILGPTMICITSTYECLIWPLLSTVHPASPPLLCTREDVEVAESPLRVLAETPDSFEKHIRSILQRSVANPAFLNCFTQLRKIKVETLFLRASEKDIAPPPEECLQLLSRATQVFREQYILKQDLAKEEIQRRVKLLCDQKKKQLEDLSYCREERKSLREMAERLADKYEEAKEKQEDIMNRMKKLLHSFHSELPVLSDSERDMKKELQLIPDQLRHLGNAIKQVTMKKDYQQQKMEKVLSLPKPTIILSAYQRKCIQSILKEEGEHIREMVKQINDIRNHVNF

SEQ ID NO: 56369 - protein, 741 aa, Homo sapiens; identical to SEQ ID NO: 56367

SEQ ID NO: 56370 - protein, 819 aa, Homo sapiens
MDTEGFGELLQQAEQLAAETEGISELPHVERNLQEIQQAGERLRSRTLTRTSQETADVKASVLLGSRGLDISHISQRLESLSAATTFEPLEPVKDTDIQGFLKNEKDNALLSAIEESRKRTFGMAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 56371 - protein, 696 aa, Homo sapiens
MAEEYHRESMLVEWEQVKQRILHTLLASGEDALDFTQESEPSYISDVGPPGRSSLDNIEMAYARQIYIYNEKIVNGHLQPNLVDLCASVAELDDKSISDMWTMVKQMTDVLLTPATDALKNRSSVEVRMEFVRQALAYLEQSYKNYTLVTVFGNLHQAQLGGVPGTYQLVRSFLNIKLPAPLPGLQDGEVEGHPVWALIYYCMRCGDLLAASQVVNRAQHQLGEFKTWFQEYMNSKDRRLSPATENKLRLHYRRALRNNTDPYKRAVYCIIGRCDVTDNQSEVADKTEDYLWLKLNQVCFDDDGTSSPQDRLTLSQFQKQLLEDYGESHFTVNQQPFLYFQVLFLTAQFEAAVAFLFRMERLRCHAVHVALVLFELKLLLKSSGQSAQLLSHEPGDPPCLRRLNFVRLLMLYTRKFESTDPREALQYFYFLRDEKDSQGENMFLRCVSELVIESREFDMILGKLENDGSRKPGVIDKFTSDTKPIINKVASVAENKGLFEEAAKLYDLAKNADKVLELMNKLLSPVVPQISAPQSNKERLKNMALSIAERYRAQGISANKFVDSTFYLLLDLITFFDEYHSGHIDRAFDIIERLKLVPLNQESVEERVAAFRNFSDEIRHNLSEVLLATMNILFTQFKRLKGTSPSSSSRPQRVIEDRDSQLRSQARTLITFAGMIPYRTSGDTNARLVQMEVLMN

SEQ ID NO: 56372 - protein, 696 aa, Homo sapiens; identical to SEQ ID NO: 56371

SEQ ID NO: 56373 - protein, 1800 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDRHYDLNQLLEPRSITADPLDYRLSWHLWEVLRALNYTHLSAQCEGVLQASYAGQLESEGLWEWAIFVLLHIDNSGIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 56374 - protein, 1726 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDSIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQVDCSGNDLEQLHIKVTSLCSRIEQIQCYSAKDRLAQSDMAKRVANLLRVVLSLHHPPDRTSDSTPDPQRVPLRLLAPHIGRLPMPEDYAMDELRSLTQSYLRELAVGSL

SEQ ID NO: 56375 - protein, 1638 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQSQSPEVEQLGRVVELDSDMVDITQEPVLDTMLEESMPEDQEPVSASTHIASSLGINPHVLQIMKASLLTDEEDVDMALDQRFSRLPSKADTSQEICSPRLPISASHSSKTRSLVGGLLQSKFTSGAFLSPSVSVQECRTPRAASLMNIPSTSSWSVPPPLTSVFTMPSPAPEVPLKTVGTRRQLGLVPREKSVTYGKGKLLMDMALFMGRSFRVGWGPNWTLANSGEQLNGSHELENHQIADSMEFGFLPNPVAVKPLTESPFKVHLEKLSLRQRKPDEDMKLYQTPLELKLKHSTVHVDELCPLIVPNLGVAVIHDYADWVKEASGDLPEAQIVKHWSLTWTLCEALWGHLKELDSQLNEPREYIQILERRRAFSRWLSCTATPQIEEEVSLTQKNSPVEAVFSYLTGKRISEACSLAQQSGDHRLALLLSQFVGSQSVRELLTMQLVDWHQLQADSFIQDERLRIFALLAGKPVWQLSEKKQINVCSQLDWKRSLAIHLWYLLPPTASISRALSMYEEAFQNTSDSDRYACSPLPSYLEGSGCVIAEEQNSQTPLRDVCFHLLKLYSDSIREKAVRELLTRHCQLLETPESWAKETFLTQKLRVPAKWIHEAKAVRAHMESDKHLEALCLFKAEHWNRCHKLIIRHLASDAIINENYDYLKGFLEDLAPPERSSLIQDWETSGLVYLDYIRVIEMLRHIQQIALFCVEWIAQVMTWSSYTSK

SEQ ID NO: 56376 - protein, 920 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQVEKKGQ

SEQ ID NO: 56377 - protein, 937 aa, Homo sapiens
MFNKSFGTPFGGGTGGFGTTSTFGQNTGFGTTSGGAFGTSAFGSSNNTGGLFGNSQTKPGGLFGTSSFSQPATSTSTGFGFGTSTGTANTLFGTASTGTSLFSSQNNAFAQNKPTGFGNFGTSTSSGGLFGTTNTTSNPFGSTSGSLFGPSSFTAAPTGTTIKFNPPTGTDTMVKAGVSTNISTKHQCITAMKEYESKSLEELRLEDYQANRKGPQNQVGAGTTTGLFGSSPATSSATGLFSSSTTNSGFAYGQNKTAFGTSTTGFGTNPGGLFGQQNQQTTSLFSKPFGQATTTQNTGFSFGNTSTIGQPSTNTMGLFGVTQASQPGGLFGTATNTSTGTAFGTGTGLFGQTNTGFGAVGSTLFGNNKLTTFGSSTTSAPSFGTTSGGLFGNKPTLTLGTNTNTSNFGFGTNTSGNSIFGSKPAPGTLGTGLGAGFGTALGAGQASLFGNNQPKIGGPLGTGAFGAPGFNTTTATLGFGAPQAPVALTDPNASAAQQAVLQQHINSLTYSPFGDSPLFRNPMSDPKKKEERLKPTNPAAQKALTTPTHYKLTPRPATRVRPKALQTTGTAKSHLFDGLDDDEPSLANGAFMPKKSIKKLVLKNLNNSNLFSPVNRDSENLASPSEYPENGERFSFLSKPVDENHQQDGDEDSLVSHFYTNPIAKPIPQTPESAGNKHSNSNSVDDTIVALNMRAALRNGLEGSSEETSFHDESLQDDREEIENNSYHMHPAGIILTKVGYYTIPSMDDLAKITNEKGECIVSDFTIGRKGYGSIYFEGDVNLTNLNLDDIVHIRRKEVVVYLDDNQKPPVGEGLNRKAEVTLDGVWPTDKTSRCLIKSPDRLADINYEGRLEAVSRKQGAQFKEYRPETGSWVFKVSHFSKYGLQDSDEEEEEHPSKTSTKKLKTAPLPPASQTTPLQMALNGKPAPPPQVEKKGQ

SEQ ID NO: 56378 - protein, 576 aa, Homo sapiens
MSTGFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 56379 - protein, 587 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 56380 - protein, 599 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGPQPSLGVSFGTPFGSGIGTGLQSSGLGSSNLGGFGTSSGFGCSTTGASTFGFGTTNKPSGSLSAGFGSSSTSGFNFSNPGITASAGLTFGVSNPASAGFGTGGQLLQLKKPPAGNKRGKR

SEQ ID NO: 56381 - protein, 504 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGDKWCNVAELKNRTQLSLFVNKLELSCYCVIDLLYNEQ

SEQ ID NO: 56382 - protein, 485 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQVQEEISRMSSKAMLKVQEDIKALKQLLSLAANGIQRNTLNIDKLKIETAQELKNAEIALRTQKTPPGLQHEYAAPADYFRILVQQFEVQLQQYRQQIEELENHLATQANNSHITPQDLSMAMQKIYQTFVALAAQLQSIHENVKVLKEQYLGYRKMFLGDAVDVFETRRAEAKKWQNTPRVTTGPTPFSTMPNAAAVAMAATLTQQQQPATGLNAFKL

SEQ ID NO: 56383 - protein, 435 aa, Homo sapiens
MSGFLEELLGEKLVTGGGEEVDVHSLGARGISLLGLYFGCSLSAPCAQLSASLAAFYGRLRGDAAAGPGPGAGAGAAAEPEPRRRLEIVFVSSDQDQRQWQDFVRDMPWLALPYKEKHRKLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 56384 - protein, 327 aa, Homo sapiens
MADVSLHRNPATLKLWNKYRISNIPSLIFLDATTGKVVCRNGLLVIRDDPEGLEFPWGPKPFREVIAGPLLRNNGQSLESSSLEGSHVGVYFSAHWCPPCRSLTRVLVESYRKIKEAGQNFEIIFVSADRSEESFKQYFSEMPWLAVPYTDEARRSRLNRLYGIQGIPTLIMLDPQGEVITRQGRVEVLNDEDCREFPWHPKPVLELSDSNAAQLNEGPCLVLFVDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 56385 - protein, 126 aa, Homo sapiens
MPWLAVPYTDEARRSRLNRLYGIQDSEDDGESEAAKQLIQPIAEKIIAKYKAKEEEAPLLFFVAGEDDMTDSLRDYTNLPEAAPLLTILDMSARAKYVMDVEEITPAIVEAFVNDFLAEKLKPEPI

SEQ ID NO: 56386 - protein, 327 aa, Homo sapiens; identical to SEQ ID NO: 56384

SEQ ID NO: 56387 - protein, 391 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 56388 - protein, 391 aa, Homo sapiens; identical to SEQ ID NO: 56387

SEQ ID NO: 56389 - protein, 323 aa, Homo sapiens
MMQNPQILAALQERLDGLVETPTGYIESLPRVVKRRVNALKNLQVKCAQIEAKFYEEVHDLERKYAVLYQPLFDKEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 56390 - protein, 349 aa, Homo sapiens
MMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 56391 - protein, 208 aa, Homo sapiens
MVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 56392 - protein, 328 aa, Homo sapiens
MADIDNLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 56393 - protein, 368 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEVMFTK

SEQ ID NO: 56394 - protein, 264 aa, Homo sapiens
MADIDNKEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKK

SEQ ID NO: 56395 - protein, 385 aa, Homo sapiens
KEQSELDQDLDDVEEVEEEETGEETKLKARQLTVQMMQNPQILAALQERLDGLVETPTGYIESLPRVVKRRVNALKNLQVKCAQIEAKFYEEVHDLERKYAVLYQPLFDKRFEIINAIYEPTEEECEWKPDEEDEISEELKEKAKIEDEKKDEEKEDPKGIPEFWLTVFKNVDLLSDMVQEHDEPILKHLKDIKVKFSDAGQPMSFVLEFHFEPNEYFTNEVLTKTYRMRSEPDDSDPFSFDGPEIMGCTGCQIDWKKGKNVTLKTIKKKQKHKGRGTVRTVTKTVSNDSFFNFFAPPEVPESGDLDDDAEAILAADFEIGHFLRERIIPRSVLYFTGEAIEDDDDDYDEEGEEADEEGEEEGDEENDPDYDPKKDQNPAECKQQ

SEQ ID NO: 56396 - protein, 506 aa, Homo sapiens
MAEADFKMVSEPVAHGVAEEEMASSTSDSGEESDSSSSSSSTSDSSSSSSTSGSSSGSGSSSSSSGSTSSRSRLYRKKRVPEPSRRARRAPLGTNFVDRLPQAVRNRVQALRNIQDECDKVDTLFLKAIHDLERKYAELNKPLYDRRFQIINAEYEPTEEECEWNSEDEEFSSDEEVQDNTPSEMPPLEGEEEENPKENPEVKAEEKEVPKEIPEVKDEEKEVPKEIPEVKAEEKADSKDCMEATPEVKEDPKEVPQVKADDKEQPKATEAKARAAVRETHKRVPEERLQDSVDLKRARKGKPKREDPKGIPDYWLIVLKNVDKLGPMIQKYDEPILKFLSDVSLKFSKPGQPVSYTFEFHFLPNPYFRNEVLVKTYIIKAKPDHNDPFFSWGWEIEDCKGCKIDWRRGKDVTVTTTQSRTTATGEIEIQPRVVPNASFFNFFSPPEIPMIGKLEPREDAILDEDFEIGQILHDNVILKSIYYYTGEVNGTYYQFGKHYGNKKYRK

SEQ ID NO: 56397 - protein, 499 aa, Homo sapiens
MVSEPVAHGVAEEEMASSTSDSGEESDSSSSSSSTSDSSSSSSTSGSSSGSGSSSSSSGSTSSRSRLYRKKRVPEPSRRARRAPLGTNFVDRLPQAVRNRVQALRNIQDECDKVDTLFLKAIHDLERKYAELNKPLYDRRFQIINAEYEPTEEECEWNSEDEEFSSDEEVQDNTPSEMPPLEGEEEENPKENPEVKAEEKEVPKEIPEVKDEEKEVPKEIPEVKAEEKADSKDCMEATPEVKEDPKEVPQVKADDKEQPKATEAKARAAVRETHKRVPEERLQDSVDLKRARKGKPKREDPKGIPDYWLIVLKNVDKLGPMIQKYDEPILKFLSDVSLKFSKPGQPVSYTFEFHFLPNPYFRNEVLVKTYIIKAKPDHNDPFFSWGWEIEDCKGCKIDWRRGKDVTVTTTQSRTTATGEIEIQPRVVPNASFFNFFSPPEIPMIGKLEPREDAILDEDFEIGQILHDNVILKSIYYYTGEVNGTYYQFGKHYGNKKYRK

SEQ ID NO: 56398 - protein, 375 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKV

SEQ ID NO: 56399 - protein, 386 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKGKGQSKSKDEDSEFTLASDFEIGHFFRERIVPRAVLYFTGEAIEDDDNFEEGEEGEEEELEGDEEGEDEDDAEINPKKEPSQPAECKQQ

SEQ ID NO: 56400 - protein, 178 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQ

SEQ ID NO: 56401 - protein, 386 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSKVVVTEKAAATAEEPDPKGIPEFWFTIFRNVDMLSELVQEYDEPILKHLQDIKVKFSDPGQPMSFVLEFHFEPNDYFTNSVLTKTYKMKSEPDKADPFSFEGPEIVDCDGCTIDWKKGKNVTVKTIKKKQKHKGRGTVRTITKQVPNESFFNFFNPLKASGDGESLDEDSEFTLASDFEIGHFFRERIVPRAVLYFTGEAIEDDDNFEEGEEGEEEELEGDEEGEDEDDAEINPKKEPSQPAECKQQ

SEQ ID NO: 56402 - protein, 128 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENE

SEQ ID NO: 56403 - protein, 140 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKLAGDMKSK

SEQ ID NO: 56404 - protein, 133 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRREFITGDVEPTDAESEWHSENEEEEKL

SEQ ID NO: 56405 - protein, 107 aa, Homo sapiens
MADHSFSDGVPSDSVEAAKNASNTEKLTDQVMQNPRVLAALQERLDNVPHTPSSYIETLPKAVKRRINALKQLQVRCAHIEAKFYEEVHDLERKYAALYQPLFDKRR

SEQ ID NO: 56406 - protein, 78 aa, Homo sapiens
MADHSFSDGVPSDSVEAAKNASNTEKLTDQVMQNPRVLAALQERLDNVPHTPSSYIETLPKAVKRRINALKQLQVRCA

SEQ ID NO: 56407 - protein, 182 aa, Homo sapiens
MADSENQGPAEPSQAAAAAEAAAEEVMAEGGAQGGDCDSAAGDPDSAAGQMAEEPQTPAENAPKPKNDFIESLPNSVKCRVLALKKLQKRCDKIEAKFDKEFQALEKKYNDIYKPLLAKIQELTGEMEGCAWTLEGEEEEEEEYEDDEEEGEDEEEEEAAAEAAAGAKHDDAHAEMPDDAKK

SEQ ID NO: 56408 - protein, 145 aa, Homo sapiens
MADSENQGPAEPSQAAAAAEAAAEEVMAEGGAQGGDCDSAAGDPDSAAGQMAEEPQTPAENAPKPKNDFIESLPNSVKCRVLALKKLQKRCDKIEAKFDKEFQALEKKYNDIYKPLLAKIQELTGEMEGCAWTLEGEERRKRVRG

SEQ ID NO: 56409 - protein, 320 aa, Homo sapiens
MEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQVHQSGSGWSPVYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 56410 - protein, 309 aa, Homo sapiens
MEEVPHDCPGADSAQAGRGASCQGCPNQRLCASGAGATPDTAIEEIKEKMKTVKHKILVLSGKGGVGKSTFSAHLAHGLAEDENTQIALLDIDICGPSIPKIMGLEGEQYVEDNLGVMSVGFLLSSPDDAVIWRGPKKNGMIKQFLRDVDWGEVDYLIVDTPPGTSDEHLSVVRYLATAHIDGAVIITTPQEVSLQDVRKEINFCRKVKLPIIGVVENMSGFICPKCKKESQIFPPTTGGAELMCQDLEVPLLGRVPLDPLIGKNCDKGQSFFIDAPDSPATLAYRSIIQRIQEFCNLHQSKEENLISS

SEQ ID NO: 56411 - protein, 271 aa, Homo sapiens
MEAAAEPGNLAGVRHIILVLSGKGGVGKSTISTELALALRHAGKKVGILDVDLCGPSIPRMLGAQGRAVHQCDRGWAPVFLDREQSISLMSVGFLLEKPDEAVVWRGPKKNALIKQFVSDVAWGELDYLVVDTPPGTSDEHMATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 56412 - protein, 130 aa, Homo sapiens
MATIEALRPYQPLGALVVTTPQAVSVGDVRRELTFCRKTGLRVMGIVENMSGFTCPHCTECTSVFSRGGGEELAQLAGVPFLGSVPLDPALMRTLEEGHDFIQEFPGSPAFAALTSIAQKILDATPACLP

SEQ ID NO: 56413 - protein, 319 aa, Homo sapiens
MGIWQRLLLFGGVSLRAGGGATAPLGGSRAMVCGRQLSGAGSETLKQRRTQIMSRGLPKQKPIEGVKQVIVVASGKGGVGKSTTAVNLALALAANDSSKAIGLLDVDVYGPSVPKMMNLKGNPELSQSNLMRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKTHIFGADGARKLAQTLGLEVLGDIPLHLNIREASDTGQPIVFSQPESDEAKAYLRIAVEVVRRLPSPSE

SEQ ID NO: 56414 - protein, 223 aa, Homo sapiens
MSKAIGLLDVDVYGPSVPKMMNLKGNPELSQSNLMRPLLNYGIACMSMGFLVEESEPVVWRGLMVMSAIEKLLRQVDWGQLDYLVVDMPPGTGDVQLSVSQNIPITGAVIVSTPQDIALMDAHKGAEMFRRVHVPVLGLVQNMSVFQCPKCKHKTHIFGADGARKLAQTLGLEVLGDIPLHLNIREASDTGQPIVFSQPESDEAKAYLRIAVEVVRRLPSPSE

SEQ ID NO: 56415 - protein, 1040 aa, Homo sapiens
MGEEGGSASHDEEERASVLLGHSPGCEMCSQEAFQAQRSQLVELLVSGSLEGFESVLDWLLSWEVLSWEDYEGFHLLGQPLSHLARRLLDTVWNKGTWACQKLIAAAQEAQADSQSPKLHGCWDPHSLHPARDLQSHRPAIVRRLHSHVENMLDLAWERGFVSQYECDEIRLPIFTPSQRARRLLDLATVKANGLAAFLLQHVQELPVPLALPLEAATCKKYMAKLRTTVSAQSRFLSTYDGAETLCLEDIYTENVLEVWADVGMAGPPQKSPATLGLEELFSTPGHLNDDADTVLVVGEAGSGKSTLLQRLHLLWAAGQDFQEFLFVFPFSCRQLQCMAKPLSVRTLLFEHCCWPDVGQEDIFQLLLDHPDRVLLTFDGFDEFKFRFTDRERHCSPTDPTSVQTLLFNLLQGNLLKNARKVVTSRPAAVSAFLRKYIRTEFNLKGFSEQGIELYLRKRHHEPGVADRLIRLLQETSALHGLCHLPVFSWMVSKCHQELLLQEGGSPKTTTDMYLLILQHFLLHATPPDSASQGLGPSLLRGRLPTLLHLGRLALWGLGMCCYVFSAQQLQAAQVSPDDISLGFLVRAKGVVPGSTAPLEFLHITFQCFFAAFYLALSADVPPALLRHLFNCGRPGNSPMARLLPTMCIQASEGKDSSVAALLQKAEPHNLQITAAFLAGLLSREHWGLLAECQTSEKALLRRQACARWCLARSLRKHFHSIPPAAPGEAKSVHAMPGFIWLIRSLYEMQEERLARKAARGLNVGHLKLTFCSVGPTECAALAFVLQHLRRPVALQLDYNSVGDIGVEQLLPCLGVCKALYLRDNNISDRGICKLIECALHCEQLQKLALFNNKLTDGCAHSMAKLLACRQNFLALRLGNNYITAAGAQVLAEGLRGNTSLQFLGFWGNRVGDEGAQALAEALGDHQSLRWLSLVGNNIGSVGAQALALMLAKNVMLEELCLEENHLQDEGVCSLAEGLKKNSSLKILKLSNNCITYLGAEALLQALERNDTILEVWLRGNTFSLEEVDKLGCRDTRLLL

SEQ ID NO: 56416 - protein, 180 aa, Homo sapiens
MWLLPPGQVFNAFFPSRLGNNYITAAGAQVLAEGLRGNTSLQFLGFWGNRVGDEGAQALAEALGDHQSLRWLSLVGNNIGSVGAQALALMLAKNVMLEELCLEENHLQDEGVCSLAEGLKKNSSLKILKLSNNCITYLGAEALLQALERNDTILEVWLRGNTFSLEEVDKLGCRDTRLLL

SEQ ID NO: 56417 - protein, 335 aa, Homo sapiens
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLDTSCRWLSKSTTRSSSSC

SEQ ID NO: 56418 - protein, 346 aa, Homo sapiens
MEDSGKTFSSEEEEANYWKDLAMTYKQRAENTQEELREFQEGSREYEAELETQLQQIETRNRDLLSENNRLRMELETIKEKFEVQHSEGYRQISALEDDLAQTKAIKDQLQKYIRELEQANDDLERAKRATIMSLEDFEQRLNQAIERNAFLESELDEKENLLESVQRLKDEARDLRQELAVQQKQEKPRTPMPSSVEAERTDTAVQATGSVPSTPIAHRGPSSSLNTPGSFRRGLDDSTGGTPLTPAARISALNIVGDLLRKVGALESKLASCRNLVYDQSPNRTGGPASGRSSKNRDGGERRPSSTSVPLGDKGLGKRLEFGKPPSHMSSSPLPSAQGVVKMLL

SEQ ID NO: 56419 - protein, 335 aa, Homo sapiens; identical to SEQ ID NO: 56417

SEQ ID NO: 56420 - protein, 335 aa, Homo sapiens; identical to SEQ ID NO: 56417

SEQ ID NO: 56421 - protein, 156 aa, Homo sapiens
MGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 56422 - protein, 179 aa, Homo sapiens
MSGISPQQMGEPEGSWSGKNPGTMGASRLYTLVLVLQPQRVLLGMKKRGFGAGRWNGFGGKVQEGETIEDGARRELQEESGLTVDALHKVGQIVFEFVGEPELMDVHVFCTDSIQGTPVESDEMRPCWFQLDQIPFKDMWPDDSYWFPLLLQKKKFHGYFKFQGQDTILDYTLREVDTV

SEQ ID NO: 56423 - protein, 156 aa, Homo sapiens; identical to SEQ ID NO: 56421

SEQ ID NO: 56424 - protein, 156 aa, Homo sapiens; identical to SEQ ID NO: 56421

SEQ ID NO: 56425 - protein, 179 aa, Homo sapiens; identical to SEQ ID NO: 56422

SEQ ID NO: 56426 - protein, 179 aa, Homo sapiens; identical to SEQ ID NO: 56422

SEQ ID NO: 56427 - protein, 37 aa, Homo sapiens
MGASRLYTLVLVLQPQRVLLGMKKRGFGAGRWNGFGG

SEQ ID NO: 56428 - protein, 164 aa, Homo sapiens
MKCKPNQTRTYDPEGFKKRAACLCFRSEREDEVLLVSSSRYPDRWIVPGGGMEPEEEPGGAAVREVYEEAGVKGKLGRLLGVFEQNQDPKHRTYVYVLTVTELLEDWEDSVSIGRKREWFKVEDAIKVLQCHKPVHAEYLEKLKLGGSPTNGNSMAPSSPDSDP

SEQ ID NO: 56429 - protein, 164 aa, Homo sapiens; identical to SEQ ID NO: 56428

SEQ ID NO: 56430 - protein, 147 aa, Homo sapiens
MALRACGLIIFRRCLIPKVDNNAIEFLLLQASDGIHHWTPPKGHVEPGEDDLETALRETQEEAGIEAGQLTIIEGFKRELNYVARNKPKTVIYWLAEVKDYDVEIRLSHEHQAYRWLGLEEACQLAQFKEMKAALQEGHQFLCSIEA

SEQ ID NO: 56431 - protein, 147 aa, Homo sapiens; identical to SEQ ID NO: 56430

SEQ ID NO: 56432 - protein, 147 aa, Homo sapiens; identical to SEQ ID NO: 56430

SEQ ID NO: 56433 - protein, 147 aa, Homo sapiens; identical to SEQ ID NO: 56430

SEQ ID NO: 56434 - protein, 147 aa, Homo sapiens; identical to SEQ ID NO: 56430

SEQ ID NO: 56435 - protein, 464 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARQEVVEKYEIYGDSVDCLPSCQLEVQLYQKKIQDLSDNREKLASILKESLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 56436 - protein, 464 aa, Homo sapiens; identical to SEQ ID NO: 56435

SEQ ID NO: 56437 - protein, 202 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKT

SEQ ID NO: 56438 - protein, 145 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQY

SEQ ID NO: 56439 - protein, 221 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTCCKREIPKRSQIFQRKPSV

SEQ ID NO: 56440 - protein, 417 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGIINFIHFREACRETYMEFLWQYKSSADKMQQLNAAHQEALMKLERLDSVPVEEQEEFKQLSDGIQELQQSLNQDFHQKTIVLQEGNSQKKSNISEKTKRLNELKLSVVSLKEIQESLKTKIVDSPEKLKNYKEKMKDTVQKLKNARSLNLEDQIESDESELKKLKTEENSFKRLMIVKKEKLATAQFKINKKHEDVKQYKRTVIEDCNKVQEKRGAVYERVTTINQEIQKIKLGIQQLKDAAEREKLKSQEIFLNLKTALEKYHDGIEKAAEDSYAKIDEKTAELKRKMFKMST

SEQ ID NO: 56441 - protein, 124 aa, Homo sapiens
METLSFPRYNVAEIVIHIRNKILTGADGKNLTKNDLYPNPKPEVLHMIYMRALQIVYGIRLEHFYMMPVNSEVMYPHLMEGFLPFSNLVTHLDSFLPICRVNDFETADILCPKAKRTSRFLSGI

SEQ ID NO: 56442 - protein, 233 aa, Homo sapiens
MNKLRQSFRRKKDVYVPEASRPHQWQTDEEGVRTGKCSFPVKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIE

SEQ ID NO: 56443 - protein, 651 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 56444 - protein, 603 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 56445 - protein, 640 aa, Homo sapiens
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQANGTDSAFHVLAKPAHTALAPVAMPVRETNPWAHAPDAANKEIAATCSGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 56446 - protein, 505 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 56447 - protein, 640 aa, Homo sapiens; identical to SEQ ID NO: 56445

SEQ ID NO: 56448 - protein, 456 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 56449 - protein, 258 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNP

SEQ ID NO: 56450 - protein, 592 aa, Homo sapiens
MNKLRQSFRRKKDVYVPEASRPHQWQTDEEGVRTGKCSFPVKYLGHVEVDESRGMHICEDAVKRLKATGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEMNNPHAIPRRHAPIEQLARQGSFRGFPALSQKMSPFKRQLSLRINELPSTMQRKTDFPIKNAVPEVEGEAESISSLCSQITNAFSTPEDPFSSAPMTKPVTVVAPQSPTFQGTEWGQSSGAASPGLFQAGHRRTPSEADRWLEEVSKSVRAQQPQASAAPLQPVLQPPPPTAISQPASPFQGNAFLTSQPVPVGVVPALQPAFVPAQSYPVANGMPYPAPNVPVVGITPSQMVANVFGTAGHPQAAHPHQSPSLVRQQTFPHYEASSATTSPFFKPPAQHLNGSAAFNGVDDGRLASADRHTEVPTGTCPVDPFEAQWAALENKSKQRTNPSPTNPFSSDLQKTFEIEL

SEQ ID NO: 56451 - protein, 67 aa, Homo sapiens
MNKLRQSFRRKKDVYVPEASRPHQWQTDEEGVRTGKCSFPVKYLGHVEVDESRGMHICEDAVKRLKA

SEQ ID NO: 56452 - protein, 651 aa, Homo sapiens; identical to SEQ ID NO: 56443

SEQ ID NO: 56453 - protein, 258 aa, Homo sapiens; identical to SEQ ID NO: 56449

SEQ ID NO: 56454 - protein, 603 aa, Homo sapiens; identical to SEQ ID NO: 56444

SEQ ID NO: 56455 - protein, 640 aa, Homo sapiens; identical to SEQ ID NO: 56445

SEQ ID NO: 56456 - protein, 609 aa, Homo sapiens
MSRSAAASGGPRRPERHLPPAPCGAPGPPETCRTEPDGAGTMNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 56457 - protein, 568 aa, Homo sapiens
MNKLRQSLRRRKPAYVPEASRPHQWQADEDAVRKGTCSFPVRYLGHVEVEESRGMHVCEDAVKKLKAMGRKSVKSVLWVSADGLRVVDDKTKDLLVDQTIEKVSFCAPDRNLDKAFSYICRDGTTRRWICHCFLALKDSGERLSHAVGCAFAACLERKQRREKECGVTAAFDASRTSFAREGSFRLSGGGRPAEREAPDKKKAEAAAAPTVAPGPAQPGHVSPTPATTSPGEKGEAGTPVAAGTTAAAIPRRHAPLEQLVRQGSFRGFPALSQKNSPFKRQLSLRLNELPSTLQRRTDFQVKGTVPEMEPPGAGDSDSINALCTQISSSFASAGAPAPGPPPATTGTSAWGEPSVPPAAAFQPGHKRTPSEAERWLEEVSQVAKAQQQQQQQQQQQQQQQQQQQQAASVAPVPTMPPALQPFPAPVGPFDAAPAQVAVFLPPPHMQPPFVPAYPGLGYPPMPRVPVVGITPSQMVANAFCSAAQLQPQPATLLGKAGAFPPPAIPSAPGSQARPRPNGAPWPPEPAPAPAPELDPFEAQWAALEGKATVEKPSNPFSGDLQKTFEIEL

SEQ ID NO: 56458 - protein, 481 aa, Homo sapiens
MKGRGMLVLLLHAVVLGLPSAWAVGACARACPAACACSTVERGCSVRCDRAGLLRVPAELPCEAVSIDLDRNGLRFLGERAFGTLPSLRRLSLRHNNLSFITPGAFKGLPRLAELRLAHNGDLRYLHARTFAALSRLRRLDLAACRLFSVPERLLAELPALRELAAFDNLFRRVPGALRGLANLTHAHLERGRIEAVASSSLQGLRRLRSLSLQANRVRAVHAGAFGDCGVLEHLLLNDNLLAELPADAFRGLRRLRTLNLGGNALDRVARAWFADLAELELLYLDRNSIAFVEEGAFQNLSGLLALHLNGNRLTVLAWVAFQPGFFLGRLFLFRNPWCCDCRLEWLRDWMEGSGRVTDVPCASPGSVAGLDLSQVTFGRSSDGLCVDPEELNLTTSSPGPSPEPAATTVSRFSSLLSKLLAPRVPVEEAANTTGGLANASLSDSLSSRGVGGAGRQPWFLLASCLLPSVAQHVVFGLQMD

SEQ ID NO: 56459 - protein, 481 aa, Homo sapiens; identical to SEQ ID NO: 56458

SEQ ID NO: 56460 - protein, 396 aa, Homo sapiens
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 56461 - protein, 238 aa, Homo sapiens
MIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 56462 - protein, 416 aa, Homo sapiens
MSRTFSAKGGRDLVEGPQYLMPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVIPFSGALELKLQELSAEERQKYLEANMTQSALPKIIKAGFAALQLEYFFTAGPDEVRAWTIRKGTKAPQAAGKIHTDFEKGFIMAEVMKYEDFKEEGSENAVKAAGKYRQQGRNYIVEDGDIIFFKFNTPQQPKKK

SEQ ID NO: 56463 - protein, 116 aa, Homo sapiens
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISA

SEQ ID NO: 56464 - protein, 278 aa, Homo sapiens
MPPKKGGDGIKPPPIIGRFGTSLKIGIVGLPNVGKSTFFNVLTNSQASAENFPFCTIDPNESRVPVPDERFDFLCQYHKPASKIPAFLNVVDIAGLVKGAHNGQGLGNAFLSHISACDGIFHLTRAFEDDDITHVEGSVDPIRDIEIIHEELQLKDEEMIGPIIDKLEKVAVRGGDKKLKPEYDIMCKVKSWVIDQKKPVRFYHDWNDKEIEVLNKHLFLTSKPMVYLVNLSEKDYIRKKNKWLLESTDNKAEIILLKMEILSSSNLTHLNNRRRNKI

SEQ ID NO: 56465 - protein, 103 aa, Homo sapiens
MIGPIIDKLEKVAVRGGDKKLKPEYDIMCKVKSWVIDQKKPVRFYHDWNDKEIEVLNKHLFLTSKPMVYLVNLSEKDYIRKKNKWLIKIKEWVDKYDPGALVI

SEQ ID NO: 56466 - protein, 442 aa, Homo sapiens
MCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPLLVKLVSELTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRRECPVLS

SEQ ID NO: 56467 - protein, 1401 aa, Homo sapiens
MKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDRVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSELTPLTVHEGDDATFRCEVSPPDADVTWLRNGAVVTPGPQRQSCCSYGGCRMCGQRKARMCVSKWRQAEWVQRGPCAGCEVGSPCPTTLACPWPRMGTSTASSSMVSYWPTRAPTAARATTIAPWPGSA

SEQ ID NO: 56468 - protein, 1025 aa, Homo sapiens
MKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDRVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTESYQSQDSSNNNPELCVLLKKPKTRRLWSRFPPWRRTAGTE

SEQ ID NO: 56469 - protein, 1896 aa, Homo sapiens
MKASSGDQGSPPCFLRFPRPVRVVSGAEAELKCVVLGEPPPVVVWEKGGQQLAASERLSFPADGAEHGLLLTAALPTDAGVYVCRARNAAGEAYAAAAVTVLEPPASDPELQPAERPLPSPGSGEGAPVFLTGPRSQWVLRGAEVVLTCRAGGLPEPTLYWEKDGMALDEVWDSSHFALQPGRAEDGPGASLALRILAARLPDSGVYVCHARNAHGHAQAGALLQVHQPPESPPADPDEAPAPVVEPLKCAPKTFWVNEGKHAKFRCYVMGKPEPEIEWHWEGRPLLPDRRRLMYRDRDGGFVLKVLYCQAKDRGLYVCAARNSAGQTLSAVQLHVKEPRLRFTRPLQDVEGREHGIAVLECKVPNSRIPTAWFREDQRLLPCRKYEQIEEGTVRRLIIHRLKADDDGIYLCEMRGRVRTVANVTVKGPILKRLPRKLDVLEGENAVLLVETLEAGVEGRWSRDGEELPVICQSSSGHMHALVLPGVTREDAGEVTFSLGNSRTTTLLRVKCVKHSPPGPPILAEMFKGHKNTVLLTWKPPEPAPETPFIYRLERQEVGSEDWIQCFSIEKAGAVEVPGDCVPSEGDYRFRICTVSGHGRSPHVVFHGSAHLVPTARLVAGLEDVQVYDGEDAVFSLDLSTIIQGTWFLNGEELKSNEPEGQVEPGALRYRIEQKGLQHRLILHAVKHQDSGALVGFSCPGVQDSAALTIQESPVHILSPQDRVSLTFTTSERVVLTCELSRVDFPATWYKDGQKVEESELLVVKMDGRKHRLILPEAKVQDSGEFECRTEGVSAFFGVTVQDPPVHIVDPREHVFVHAITSECVMLACEVDREDAPVRWYKDGQEVEESDFVVLENEGPHRRLVLPATQPSDGGEFQCVAGDECAYFTVTITDVSSWIVYPSGKVYVAAVRLERVVLTCELCRPWAEVRWTKDGEEVVESPALLLQKEDTVRRLVLPAVQLEDSGEYLCEIDDESASFTVTVTEPPVRIIYPRDEVTLIAVTLECVVLMCELSREDAPVRWYKDGLEVEESEALVLERDGPRCRLVLPAAQPEDGGEFVCDAGDDSAFFTVTVTAPPERIVHPAARSLDLHFGAPGRVELRCEVAPAGSQVRWYKDGLEVEASDALQLGAEGPTRTLTLPHAQPEDAGEYVCETRHEAITFNVILAEPPVQFLALETTPSPLCVAPGEPVVLSCELSRAGAPVVWSHNGRPVQEGEGLELHAEGPRRVLCIQAAGPAHAGLYTCQSGAAPGAPSLSFTVQVAEPPVRVVAPEAAQTRVRSTPGGDLELVVHLSGPGGPVRWYKDGERLASQGRVQLEQAGARQVLRVQGARSGDAGEYLCDAPQDSRIFLVSVEEPLLVKLVSELTPLTVHEGDDATFRCEVSPPDADVTWLRNGAVVTPGPQVEMAQNGSSRILTLRGCQLGDAGTVTLRAGSTATSARLHVRETELLFLRRLQDVRAEEGQDVCLEVETGRVGAAGAVRWVRGGQPLPHDSRLSMAQDGHIHRLFIHGVILADQGTYGCESHHDRTLARLSVRPRQLRVLRPLEDVTISEGGSATFQLELSQEGVTGEWARGGVQLYPGPKCHIHSDGHRHRLVLNGLGLADSGCVSFTADSLRCAARLIVREVPVTIVRGPHDLEVTEGDTATFECELSQALADVTWEKDGNALTPSPRLRLQALGTRRLLQLRRCGPSDAGTYSCAVGTARAGPVRLTVRERTVAVLSELRSVSAREGDGATFECTVSEVETTGRWELGGRPLRPGARVRIRQEGKKHILVLSELRAEDAGEVRFQAGPAQSLALLEVEALPLQMCRHPPREKTVLVGRRAVLEVTVSRSGGHVCWLREGAELCPGDKYEMRSHGPTHSLVIHDVRPEDQGTYCCQAGQDSTHTRLLVEGN

SEQ ID NO: 56470 - protein, 893 aa, Homo sapiens
MEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKDSVTILNSGEDKIEDILVLHLDRGKDYFLTISGNYLPSCFGTSLEALCRMKRPIREVPVTKLIDLEKSLLQMVPLDEGASERPLQVPKEIWLLVDHLFKYACHQEDLFQTPGMQEELQQIIDCLDTSIPETIPGSNHSVAEALLIFLEALPEPVICYELYQRCLDSAYDPRICRQVISQLPRCHRNVFRYLMAFLRELLKFSEYNSVNANMIATLFTSLLLRPPPNLMARQTPSDRQRAIQFLLGFLLGSEED

SEQ ID NO: 56471 - protein, 901 aa, Homo sapiens
MEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPDSGLEPWLNCDPNPPDIYCIGFQELDLSTEAFFYFESVKEQEWSMAVERGLHSKAKYKKVQLVRLVGMMLLIFARKDQCRYIRDIATETVGTGIMGKMGNKGGVAVRFVFHNTTFCIVNSHLAAHVEDFERRNQDYKDICARMSFVVPNQTLPQLNIMKHEVVIWLGDLNYRLCMPDANEVKSLINKKDLQRLLKFDQLNIQRTQKKAFVDFNEGEIKFIPTYKYDSKTDRWDSSGKCRVPAWCDRILWRGTNVNQLNYRSHMELKTSDHKPVSALFHIGVKVVDERRYRKVFEDSVRIMDRMENDFLPSLELSRREFVFENVKFRQLQKEKFQISNNGQVPCHFSFIPKLNDSQYCKPWLRAEPFEGYLEPNETVDISLDVYVSKDSVTILNSGEDKIEDILVLHLDRGKDYFLTISGNYLPSCFGTSLEALCRMKRPIREVPVTKLIDLEEDSFLEKEKSLLQMVPLDEGASERPLQVPKEIWLLVDHLFKYACHQEDLFQTPGMQEELQQIIDCLDTSIPETIPGSNHSVAEALLIFLEALPEPVICYELYQRCLDSAYDPRICRQVISQLPRCHRNVFRYLMAFLRELLKFSEYNSVNANMIATLFTSLLLRPPPNLMARQTPSDRQRAIQFLLGFLLGSEED

SEQ ID NO: 56472 - protein, 814 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFERPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 56473 - protein, 838 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGWIAILGAIWLLILADIHDFEIILHRVEWATLLFFAALFVLMEALAHLHLIEYVGEQTALLIKMVPEEQRLIAAIVLVVWVSALASSLIDNIPFTATMIPVLLNLSHDPEVGLPAPPLMYALAFGACLGGNGTLIGASANVVCAGIAEQHGYGFSFMEFFRLGFPMMVVSCTVGMCYLLVAHVVVGWN

SEQ ID NO: 56474 - protein, 668 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRWRRPQQVTHNWTVYLNPRRSEHSVMSRTFEVLTRETVSISIRASLQQTQAVPLLMAHQYLRGSVETQVTIATAILAGVYALIIFEIVHRTLAAMLGSLAALAALAVIGDRPSLTHVVEWIDFETLALLFGMMILVAIFSETGFFDYCAVKAYRLSRGRVWAMIIMLCLIAAVLSAFLDNVTTMLLFTPVTIRLCEVLNLDPRQVLIAEVIFTNIGGAATAIGDPPNVIIVSNQELRKMGLDFAGFTAHMFIGICLVLLVCFPLLRLLYWNRKLYNKEPSEIVELKHEIHVWRLTAQRISPASREETAVRRLLLGKVLALEHLLARRLHTFHRQISQEDKNWETNIQELQKKHRISDGILLAKCLTVLGFVIFMFFLNSFVPGIHLDLGGLGLVQAGRYYLSTPES

SEQ ID NO: 56475 - protein, 264 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSILFSLYPDQGKLWQLLALSPLENYSVNLSSHVDSTLLQVDLAGALVASGPSRPGREEHIVVELTQADALGSRW

SEQ ID NO: 56476 - protein, 218 aa, Homo sapiens
MHLEGRDGRRYPGAPAVELLQTSVPSGLAELVAGKRRLPRGAGGADPSHSCPRGAAGQSSWAPAGQEFASFLTKGRSHSSLPQMSSSRSKDSCFTENTPLLRNSLQEKGSRCIPVYHPEFITAEESWEDSSADWERRYLLSREVSGLSASASSEKGDLLDSPHIRLRLSKLRRCVQWLKVMGLFAFVVLCSVTHNWTVYLNPRRSEHSVMSRTFEVLT

SEQ ID NO: 56477 - protein, 266 aa, Homo sapiens
MGSKTLPAPVPIHPSLQLTNYSFLQAVNGLPTVPSDHLPNLYGFSALHAVHLHQWTLGYPAMHLPRSSFSKVPGTVSSLVDARFQLPAFPWFPHVIQPKPEITAGGSVPALKTKPRFDFANLALAATQEDPAKLGRGEGPGSPAGGLGALLDVTKLSPEKKPTRGRLPSKTKKEFVCKFCGRHFTKSYNLLIHERTHTDERPYTCDICHKAFRRQDHLRDHRYIHSKEKPFKCQECGKGFCQSRTLAVHKTLHSQVKELKTSKIKC

SEQ ID NO: 56478 - protein, 266 aa, Homo sapiens; identical to SEQ ID NO: 56477

SEQ ID NO: 56479 - protein, 312 aa, Homo sapiens
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQESPHKCPTCGRTFNQRSNLKTHLLTHTDIKPYSCEQCGKVFRRNCDLRRHSLTHTPRQDF

SEQ ID NO: 56480 - protein, 276 aa, Homo sapiens
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQTSSPTAASSAAKCSGETVICGGTA

SEQ ID NO: 56481 - protein, 433 aa, Homo sapiens
MGLRAEEGKRKPPRSVRGEVSPSQGPLAQEDEARRLRSCTPACHPGKRGKGGHRARRQRSAWDLTTHPLTHRSQELRGAAATEGFLYVLLSHWVFVGAPRPPASDSWKKGLVPSAPPASRKMGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQDHLRDHRYIHSKEKPFKCQECGKGFCQSRTLAVHKTLHMQESPHKCPTCGRTFNQRSNLKTHLLTHTDIKPYSCEQCGKVFRRNCDLRRHSLTHTPRQDF

SEQ ID NO: 56482 - protein, 213 aa, Homo sapiens
MGSKALPAPIPLHPSLQLTNYSFLQAVNTFPATVDHLQGLYGLSAVQTMHMNHWTLGYPNVHEITRSTITEMAAAQGLVDARFPFPALPFTTHLFHPKQGAIAHVLPALHKDRPRFDFANLAVAATQEDPPKMGDLSKLSPGLGSPISGLSKLTPDRKPSRGRLPSKTKKEFICKFCGRHFTKSYNLLIHERTHTDERPYTCDICHKAFRRQD

SEQ ID NO: 56483 - protein, 312 aa, Homo sapiens; identical to SEQ ID NO: 56479

SEQ ID NO: 56484 - protein, 228 aa, Homo sapiens
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVASAPCRAVPLSPPWLTWPPHLQVGILIPTWRPWKNLRNWCSTRDSRRRTFSCPCRREAAFSNTRQPPGLHLQSPPYHQTQSPDHLDLPSSHDPSLLPPT

SEQ ID NO: 56485 - protein, 147 aa, Homo sapiens
MKTLFLGVTLGLAAALSFTLEEEDEGGSVHPEENPDAEDGGAWQIQRLWGQEAHIPAGAARDGRLRLLLQRPAPWGPALHGKACGICSLQGRAAVPTLAHLATSPAGRNPNTNLEALEEFKKLVQHKGLSEEDIFMPLQTGSCVLEH

SEQ ID NO: 56486 - protein, 170 aa, Homo sapiens
MKTLFLGVTLGLAAALSFTLEEEDITGTWYVKAMVVDKDFPEDRRPRKVSPVKVTALGGGNLEATFTFMREDRCIQKKILMRKTEEPGKFSAYGGRKLIYLQELPGTDDYVFYCKDQRRGGLRYMGKLVGRNPNTNLEALEEFKKLVQHKGLSEEDIFMPLQTGSCVLEH

SEQ ID NO: 56487 - protein, 170 aa, Homo sapiens; identical to SEQ ID NO: 56486

SEQ ID NO: 56488 - protein, 85 aa, Homo sapiens
MKTLFLGVTLGLAAALSFTLEEEDDGPWVHPEENPDAEDGGAWQIQRLWGQEAHVPAGAAQEGPLHLLLQRPAPWGPAPHGKACG

SEQ ID NO: 56489 - protein, 170 aa, Homo sapiens
MKTLFLGVTLGLAAALSFTLEEEDITGTWYVKAMVVDKDFPEDRRPRKVSPVKVTALGGGKLEATFTFMREDRCIQKKILMRKTEEPGKYSAYGGRKLMYLQELPRRDHYIFYCKDQHHGGLLHMGKLVGRNSDTNREALEEFKKLVQRKGLSEEDIFTPLQTGSCVPEH

SEQ ID NO: 56490 - protein, 2769 aa, Homo sapiens
MDVKERKPYRSLTRRRDAERRYTSSSADSEEGKAPQKSYSSSETLKAYDQDARLAYGSRVKDIVPQEAEEFCRTGANFTLRELGLEEVTPPHGTLYRTDIGLPHCGYSMGAGSDADMEADTVLSPEHPVRLWGRSTRSGRSSCLSSRANSNLTLTDTEHENTETDHPGGLQNHARLRTPPPPLSHAHTPNQHHAASINSLNRGNFTPRSNPSPAPTDHSLSGEPPAGGAQEPAHAQENWLLNSNIPLETRNLGKQPFLGTLQDNLIEMDILGASRHDGAYSDGHFLFKPGGTSPLFCTTSPGYPLTSSTVYSPPPRPLPRSTFARPAFNLKKPSKYCNWKCAALSAIVISATLVILLAYFVAMHLFGLNWHLQPMEGQMYEITEDTASSWPVPTDVSLYPSGGTGLETPDRKGKGTTEGKPSSFFPEDSFIDSGEIDVGRRASQKIPPGTFWRSQVFIDHPVHLKFNVSLGKAALVGIYGRKGLPPSHTQFDFVELLDGRRLLTQEARSLEGTPRQSRGTVPPSSHETGFIQYLDSGIWHLAFYNDGKESEVVSFLTTAIESVDNCPSNCYGNGDCISGTCHCFLGFLGPDCGRASCPVLCSGNGQYMKGRCLCHSGWKGAECDVPTNQCIDVACSNHGTCITGTCICNPGYKGESCEEVDCMDPTCSGRGVCVRGECHCSVGWGGTNCETPRATCLDQCSGHGTFLPDTGLCSCDPSWTGHDCSIEICAADCGGHGVCVGGTCRCEDGWMGAACDQRACHPRCAEHGTCRDGKCECSPGWNGEHCTIAHYLDRVVKEGCPGLCNGNGRCTLDLNGWHCVCQLGWRGAGCDTSMETACGDSKDNDGDGLVDCMDPDCCLQPLCHINPLCLGSPNPLDIIQETQVPVSQQNLHSFYDRIKFLVGRDSTHIIPGENPFDGGHACVIRGQVMTSDGTPLVGVNISFVNNPLFGYTISRQDGSFDLVTNGGISIILRFERAPFITQEHTLWLPWDRFFVMETIIMRHEENEIPSCDLSNFARPNPVVSPSPLTSFASSCAEKGPIVPEIQALQEEISISGCKMRLSYLSSRTPGYKSVLRISLTHPTIPFNLMKVHLMVAVEGRLFRKWFAAAPDLSYYFIWDKTDVYNQKVFGLSEAFVSVGYEYESCPDLILWEKRTTVLQGYEIDASKLGGWSLDKHHALNIQSGILHKGNGENQFVSQQPPVIGSIMGNGRRRSISCPSCNGLADGNKLLAPVALTCGSDGSLYVGDFNYIRRIFPSGNVTNILELRNKDFRHSHSPAHKYYLATDPMSGAVFLSDSNSRRVFKIKSTVVVKDLVKNSEVVAGTGDQCLPFDDTRCGDGGKATEATLTNPRGITVDKFGLIYFVDGTMIRRIDQNGIISTLLGSNDLTSARPLSCDSVMDISQVHLEWPTDLAINPMDNSLYVLDNNVVLQISENHQVRIVAGRPMHCQVPGIDHFLLSKVAIHATLESATALAVSHNGVLYIAETDEKKINRIRQVTTSGEISLVAGAPSGCDCKNDANCDCFSGDDGYAKDAKLNTPSSLAVCADGELYVADLGNIRIRFIRKNKPFLNTQNMYELSSPIDQELYLFDTTGKHLYTQSLPTGDYLYNFTYTGDGDITLITDNNGNMVNVRRDSTGMPLWLVVPDGQVYWVTMGTNSALKSVTTQGHELAMMTYHGNSGLLATKSNENGWTTFYEYDSFGRLTNVTFPTGQVSSFRSDTDSSVHVQVETSSKDDVTITTNLSASGAFYTLLQDQVRNSYYIGADGSLRLLLANGMEVALQTEPHLLAGTVNPTVGKRNVTLPIDNGLNLVEWRQRKEQARGQVTVFGRRLRVHNRNLLSLDFDRVTRTEKIYDDHRKFTLRILYDQAGRPSLWSPSSRLNGVNVTYSPGGYIAGIQRGIMSERMEYDQAGRITSRIFADGKTWSYTYLEKSMVLLLHSQRQYIFEFDKNDRLSSVTMPNVARQTLETIRSVGYYRNIYQPPEGNASVIQDFTEDGHLLHTFYLGTGRRVIYKYGKLSKLAETLYDTTKVSFTYDETAGMLKTINLQNEGFTCTIRYRQIGPLIDRQIFRFTEEGMVNARFDYNYDNSFRVTSMQAVINETPLPIDLYRYDDVSGKTEQFGKFGVIYYDINQIITTAVMTHTKHFDAYGRMKEVQYEIFRSLMYWMTVQYDNMGRVVKKELKVGPYANTTRYSYEYDADGQLQTVSINDKPLWRYSYDLNGNLHLLSPGNSARLTPLRYDIRDRITRLGDVQYKMDEDGFLRQRGGDIFEYNSAGLLIKAYNRAGSWSVRYRYDGLGRRVSSKSSHSHHLQFFYADLTNPTKVTHLYNHSSSEITSLYYDLQGHLFAMELSSGDEFYIACDNIGTPLAVFSGTGLMIKQILYTAYGEIYMDTNPNFQIIIGYHGGLYDPLTKLVHMGRRDYDVLAGRWTSPDHELWKHLSSSNVMPFNLYMFKNNNPISNSQDIKCFMTDVNSWLLTFGFQLHNVIPGYPKPDMDAMEPSYELIHTQMKTQEWDNSKSILGVQCEVQKQLKAFVTLERFDQLYGSTITSCQQAPKTKKFASSGSVFGKGVKFALKDGRVTTDIISVANEDGRRVAAILNHAHYLENLHFTIDGVDTHYFVKPGPSEGDLAILGLSGGRRTLENGVNVTVSQINTVLNGRTRRYTDIQLQYGALCLNTRYGTTLDEEKARVLELARQRAVRQAWAREQQRLREGEEGLRAWTEGEKQQVLSTGRVQGYDGFFVISVEQYPELSDSANNIHFMRQSEMGRR

SEQ ID NO: 56491 - protein, 1 aa, Homo sapiens
M

SEQ ID NO: 56492 - protein, 467 aa, Homo sapiens
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 56493 - protein, 135 aa, Homo sapiens
MPGRWRWQRDMHPARKLLSLLFLILMGTELTQVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 56494 - protein, 485 aa, Homo sapiens
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 56495 - protein, 458 aa, Homo sapiens
MGEAPGREGRGPCPQLESPRRRRVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKAIKAKMDELRPLIPVLEEYKADAKLVLQFKEEVQNLTSVLNELQEEIGAYDYDELQSRVSNLEERLRACMQKLACGKLTGISDPVTVKTSGSRFGSWMTDPLAPEGDNRVWYMDGYHNNRFVREYKSMVDFMNTDNFTSHRLPHPWSGTGQVVYNGSIYFNKFQSHIIIRFDLKTETILKTRSLDYAGYNNMYHYAWGGHSDIDLMVDESGLWAVYATNQNAGNIVVSRLDPVSLQTLQTWNTSYPKRSAGEAFIICGTLYVTNGYSGGTKVHYAYQTNASTYEYIDIPFQNKYSHISMLDYNPKDRALYAWNNGHQILYNVTLFHVIRSDEL

SEQ ID NO: 56496 - protein, 153 aa, Homo sapiens
MSVPLLKIGVVLSTMAMITNWMSQTLPSLVGLNTTKLSAAGGGTLDRSTGVLPTNPEESWQVYSSAQDSEGRCICTVVAPQQTMCSRDARTKQLRQLLEKVQNMSQSIEVLDRRTQRDLQYVEKMENQMKGLESKFKQVEESHKQHLARQFKG

SEQ ID NO: 56497 - protein, 510 aa, Homo sapiens
MRPGLSFLLALLFFLGQAAGDLGDVGPPIPSPGFSSFPGVDSSSSFSSSSRSGSSSSRSLGSGGSVSQLFSNFTGSVDDRGTCQCSVSLPDTTFPVDRVERLEFTAHVLSQKFEKELSKVREYVQLISVYEKKLLNLTVRIDIMEKDTISYTELDFELIKVEVKEMEKLVIQLKESFGGSSEIVDQLEVEIRNMTLLVEKLETLDKNNVLAIRREIVALKTKLKECEASKDQNTPVVHPPPTPGSCGHGGVVNISKPSVVQLNWRGFSYLYGAWGRDYSPQHPNKGLYWVAPLNTDGRLLEYYRLYNTLDDLLLYINARELRITYGQGSGTAVYNNNMYVNMYNTGNIARVNLTTNTIAVTQTLPNAAYNNRFSYANVAWQDIDFAVDENGLWVIYSTEASTGNMVISKLNDTTLQVLNTWYTKQYKPSASNAFMVCGVLYATRTMNTRTEEIFYYYDTNTGKEGKLDIVMHKMQEKVQSINYNPFDQKLYVYNDGYLLNYDLSVLQKPQ

SEQ ID NO: 56498 - protein, 163 aa, Homo sapiens
MAEDRPQQPQLDMPLVLDQGLTRQMRLRVESLKQRGEKRQDGEKLLQPAESVYRLNFTQQQRLQFERWNVVLDKPGKVTITGTSQNWTPDLTNLMTRQLLDPTAIFWRKEDSDAIDWNEADALEFGERLSDLAKIRKVMYFLVTFGEGVEPANLKASVVFNQL

SEQ ID NO: 56499 - protein, 312 aa, Homo sapiens
MDGGNQSEGSEFLLLGMSESPEQQRILFWMFLSMYLVTVVGNVLIILAISSDSRLHTPVYFFLANLSFTDLFFVTNTIPKMLVNLQSHNKAISYAGCLTQLYFLVSLVALDNLILAVMAYDRYVAICCPLHYTTAMSPKLCILLLSLCWVLSVLYGLIHTLLMTRVTFCGSRKIHYIFCEMYVLLRMACSNIQINHTVLIATGCFIFLIPFGFVIISYVLIIRAILRIPSVSKKYKAFSTCASHLGAVSLFYGTLCMVYLKPLHTYSVKDSVATVMYAVVTPMMNPFIYSLRNKDMHGALGRLLDKHFKRLT

SEQ ID NO: 56500 - protein, 312 aa, Homo sapiens
MSGTNQSSVSEFLLLGLSRQPQQQHLLFVFFLSMYLATVLGNLLIILSVSIDSCLHTPMYFFLSNLSFVDICFSFTTVPKMLANHILETQTISFCGCLTQMYFVFMFVDMDNFLLAVMAYDHFVAVCHPLHYTAKMTHQLCALLVAGLWVVANLNVLLHTLLMAPLSFCADNAITHFFCDVTPLLKLSCSDTHLNEVIILSEGALVMITPFLCILASYMHITCTVLKVPSTKGRWKAFSTCGSHLAVVLLFYSTIIAVYFNPLSSHSAEKDTMATVLYTVVTPMLNPFIYSLRNRYLKGALKKVVGRVVFSV

SEQ ID NO: 56501 - protein, 307 aa, Homo sapiens
MNHSVVTEFIILGLTKKPELQGIIFLFFLIVYLVAFLGNMLIIIAKIYNNTLHTPMYVFLLTLAVVDIICTTSIIPKMLGTMLTSENTISYAGCMSQLFLFTWSLGAEMVLFTTMAYDRYVAICFPLHYSTIMNHHMCVALLSMVMAIAVTNSWVHTALIMRLTFCGPNTIDHFFCEIPPLLALSCSPVRINEVMVYVADITLAIGDFILTCISYGFIIVAILRIRTVEGKRKAFSTCSSHLTVVTLYYSPVIYTYIRPASSYTFERDKVVAALYTLVTPTLNPMVYSFQNREMQAGIRKVFAFLKH

SEQ ID NO: 56502 - protein, 309 aa, Homo sapiens
MENRNNMTEFVLLGLTENPKMQKIIFVVFFVIYIITVVGYVLIVVTITASPSLGSPMYLSLAYLSFIDACYSSVNTPNLITHSLYGKKAILFNGCMTQVFGEHFFGGAEGILLTVMAYDHYVAICKPLHYMTIMNQCVCALLMGVVWMGGFLHATIQILFIFQLPFCGPNVIDHFMCDLNPLLNLACTDTHMLELFIAANSGFICLLNFALLLVSYVVILCSLRTHSLEARHKALSTCVSHITVVILFFVPCIFVYMRPAATLPIDKAVAIFYTMITPMLNPLIYTLKNAQMKNAIRKLCSRKDISGDK

SEQ ID NO: 56503 - protein, 325 aa, Homo sapiens
MFLYLCFIFQRTCSEEMEEENATLLTEFVLTGFLHQPDCKIPLFLAFLVIYLITIMGNLGLIVLIWKDPHLHIPMYLFLGSLAFVDASLSSTVTPKMLINFLAKSKMISLSECMVQFFSLVTTVTTECFLLATMAYDRYVAICKALLYPVIMTNELCIQLLVLSFIGGLLHALIHEAFSFRLTFCNSNIIQHFYCDIIPLLKISCTDSSINFLMVFIFAGSVQVFTIGTILISYTIILFTILEKKSIKGIRKAVSTCGAHLLSVSLYYGPLTFKYLGSASPQADDQDMMESLFYTVIVPLLNPMIYSLRNKQVIASFTKMFKSNV

SEQ ID NO: 56504 - protein, 320 aa, Homo sapiens
METGNQTHAQEFLLLGFSATSEIQFILFGLFLSMYLVTFTGNLLIILAICSDSHLHTPMYFFLSNLSFADLCFTSTTVPKMLLNILTQNKFITYAGCLSQIFFFTSFGCLDNLLLTVMAYDRFVAVCHPLHYTVIMNPQLCGLLVLGSWCISVMGSLLETLTVLRLSFCTEMEIPHFFCDLLEVLKLACSDTFINNVVIYFATGVLGVISFTGIFFSYYKIVFSILRISSAGRKHKAFSTCGSHLSVVTLFYGTGFGVYLSSAATPSSRTSLVASVMYTMVTPMLNPFIYSLRNTDMKRALGRLLSRATFFNGDITAGLS

SEQ ID NO: 56505 - protein, 319 aa, Homo sapiens
MERGNQTEVGNFLLLGFAEDSDMQLLLHGLFLSMYLVTIIGNLLIILTISSDSHLHTPMYFFLSNLSFADICFTSTTVPKMLVNIQTQSKMITFAGCLTQIFFFIAFGCLDNLLLTMTAYDRFVAICYPLHYTVIMNPRLCGLLVLGSWCISVMGSLLETLTILRLSFCTNMEIPHFFCDPSEVLKLACSDTFINNIVMYFVTIVLGVFPLCGILFSYSQIFSSVLRVSARGQHKAFSTCGSHLSVVSLFYGTGLGVYLSSAVTPPSRTSLAASVMYTMVTPMLNPFIYSLRNKDMKGSLGRLLLRATSLKEGTIAKLS

SEQ ID NO: 56506 - protein, 312 aa, Homo sapiens
MEAENLTELSKFLLLGLSDDPELQPVLFGLFLSMYLVTVLGNLLIILAVSSDSHLHTPMYFFLSNLSFVDICFISTTVPKMLVSIQARSKDISYMGCLTQVYFLMMFAGMDTFLLAVMAYDRFVAICHPLHYTVIMNPCLCGLLVLASWFIIFWFSLVHILLMKRLTFSTGTEIPHFFCEPAQVLKVACSNTLLNNIVLYVATALLGVFPVAGILFSYSQIVSSLMGMSSTKGKYKAFSTCGSHLCVVSLFYGTGLGVYLSSAVTHSSQSSSTASVMYAMVTPMLNPFIYSLRNKDVKGALERLLSRADSCP

SEQ ID NO: 56507 - protein, 323 aa, Homo sapiens
MDSDASLVSSRPSSPEPDDLFLPARSKGSSGSAFTGGTVSSSTPSDCPPELSAELRGAMGSAGAHPGDKLGGSGFKSSSSSTSSSTSSAAASSTKKDKKQMTEPELQQLRLKINSRERKRMHDLNIAMDGLREVMPYAHGPSVRKLSKIATLLLARNYILMLTNSLEEMKRLVSEIYGGHHAGFHPSACGGLAHSAPLPAATAHPAAAAHAAHHPAVHHPILPPAAAAAAAAAAAAAVSSASLPGSGLPSVGSIRPPHGLLKSPSAAAAAPLGGGGGGSGASGGFQHWGGMPCPCSMCQVPPPHHHVSAMGAGSLPRLTSDAK

SEQ ID NO: 56508 - protein, 323 aa, Homo sapiens; identical to SEQ ID NO: 56507

SEQ ID NO: 56509 - protein, 62 aa, Homo sapiens
MDSDASLVSSRPSSPEPDDLFLPARSKGSSGSAFTGGTVSSSTPSDCPPELSAELRGAMGSA

SEQ ID NO: 56510 - protein, 440 aa, Homo sapiens
MEYQILKMSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCSTQISSLKEHNMYPTPSGFTSSLFTVSGMQTVDTINSLSVVTQPKVTKIPKQYRTKETTFGATLSKDTTFTSTDKAFVPYPEDTSTETINSHEAAAATLTIHLQDGMVTNTSLTSSTKSSPTPMTLSITSGMPNNFSEMPQQSTTLNLWREETTTNVKTPLPSVANAWKVNASFLLLLNVVVMLAV

SEQ ID NO: 56511 - protein, 272 aa, Homo sapiens
MNSDSSSVSSRASSPDMDEMYLRDHHHRHHHHQESRLNSVSSTQGDMMQKMPGESLSRAGAKAAGESSKYKIKKQLSEQDLQQLRLKINGRERKRMHDLNLAMDGLREVMPYAHGPSVRKLSKIATLLLARNYILMLTSSLEEMKRLVGEIYGGHHSAFHCGTVGHSAGHPAHAANSVHPVHPILGGALSSGNASSPLSAASLPAIGTIRPPHSLLKAPSTPPALQLGSGFQHWAGLPCPCTICQMPPPPHLSALSTANMARLSAESKDLLK

SEQ ID NO: 56512 - protein, 124 aa, Homo sapiens
MWKGCLTLYTGRGGELQKIGEFCMVYSEVPNFSEPNPDYRGQQNKGAQSEQKNNSMNSNMGTGTFGPVGNGVHTGPESREHQFSHAGRSNGRGLINPQLQGTASNQTVMTTISNGRDPRRAFKR

SEQ ID NO: 56513 - protein, 124 aa, Homo sapiens; identical to SEQ ID NO: 56512

SEQ ID NO: 56514 - protein, 204 aa, Homo sapiens
MNRVNDPLIFIRDIKPGLKNLNVVFIVLEIGRVTKTKDGHEVRSCKVADKTGSITISVWDEIGGLIQPGDIIRLTRGYASMWKGCLTLYTGRGGELQKIGEFCMVYSEVPNFSEPNPDYRGQQNKGAQSEQKNNSMNSNMGTGTFGPVGNGVHTGPESREHQFSHAGRSNGRGLINPQLQGTASNQTVMTTISNGRDPRRAFKR

SEQ ID NO: 56515 - protein, 211 aa, Homo sapiens
MTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQNGNGLSAPPGPGGGPHPPHTPSHPPSTRITRSQPNHTPAGPPGPSSNPVSNGKETRRSSKR

SEQ ID NO: 56516 - protein, 211 aa, Homo sapiens; identical to SEQ ID NO: 56515

SEQ ID NO: 56517 - protein, 211 aa, Homo sapiens; identical to SEQ ID NO: 56515

SEQ ID NO: 56518 - protein, 152 aa, Homo sapiens
MTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAASPASENQNG

SEQ ID NO: 56519 - protein, 144 aa, Homo sapiens
MTTETFVKDIKPGLKNLNLIFIVLETGRVTKTKDGHEVRTCKVADKTGSINISVWDDVGNLIQPGDIIRLTKGYASVFKGCLTLYTGRGGDLQKIGEFCMVYSEVPNFSEPNPEYSTQQAPNKAVQNDSNPSASQPTTGPSAAS

SEQ ID NO: 56520 - protein, 802 aa, Homo sapiens
MGHPPLEFSDCYLDSPDFRERLKCYEQELERTNKFIKDVIKDGNALISAMRNYSSAVQKFSQTLQSFQFDFIGDTLTDDEINIAESFKEFAELLNEVENERMMMVHNASDLLIKPLENFRKEQIGFTKERKKKFEKDGERFYSLLDRHLHLSSKKKESQLQEADLQVDKERHNFFESSLDYVYQIQEVQESKKFNIVEPVLAFLHSLFISNSLTVELTQDFLPYKQQLQLSLQNTRNHFSSTREEMEELKKRMKEAPQTCKLPGQPTIEGYLYTQEKWALGISWVKYYCQYEKETKTLTMTPMEQKPGAKQGPLDLTLKYCVRRKTESIDKRFCFDIETNERPGTITLQALSEANRRLWMEAMDGKEPIYHSPITKQQEMELNEVGFKFVRKCINIIETKGIKTEGLYRTVGSNIQVQKLLNAFFDPKCPGDVDFHNSDWDIKTITSSLKFYLRNLSEPVMTYRLHKELVSAAKSDNLDYRLGAIHSLVYKLPEKNREMLELLIRHLVNVCEHSKENLMTPSNMGVIFGPTLMRAQEDTVAAMMNIKFQNIVVEILIEHFGKIYLGPPEESAAPPVPPPRVTARRHKPITISKRLLRERTVFYTSSLDESEDEIQHQTPNGTITSSIEPPKPPQHPKLPIQRSGETDPGRKSPSRPILDGKLEPCPEVDVGKLVSRLQDGGTKITPKATNGPMPGSGPTKTPSFHIKRPAPRPLAHHKEGDADSFSKVRPPGEKPTIIRPPVRPPDPPCRAATPQKPEPKPDIVAGNAGEITSSVVASRTRFFETASRKTGSSQGRLPGDES

SEQ ID NO: 56521 - protein, 694 aa, Homo sapiens
MGHPPLEFSDCYLDSPDFRERLKCYEQELERTNKFIKDVIKDGNALISAMRNYSSAVQKFSQTLQSFQFDFIGDTLTDDEINIAESFKEFAELLNEVENERMMMVHNASDLLIKPLENFRKEQIGFTKERKKKFEKDGERFYSLLDRHLHLSSKKKESQLQEADLQVDKERHNFFESSLDYVYQIQEVQESKKFNIVEPVLAFLHSLFISNSLTVELTQDFLPYKQQLQLSLQNTRNHFSSTREEMEELKKRMKEAPQTCKLPGQPTIEGYLYTQEKWALGISWVKYYCQYEKETKTLTMTPMEQKPGAKQGPLDLTLKYCVRRKTESIDKRFCFDIETNERPGTITLQALSEANRRLWMEAMDGKEPIYHSPITKQQEMELNEVGFKFVRKCINIIETKGIKTEGLYRTVGSNIQVQKLLNAFFDPKCPGDVDFHNSDWDIKTITSSLKFYLRNLSEPVMTYRLHKELVSAAKSDNLDYRLGAIHSLVYKLPEKNREMLELLIRHLVNVCEHSKENLMTPSNMGVIFGPTLMRAQEDTVAAMMNIKFQNIVVEILIEHFGKIYLGPPEESAAPPVPPPRVTARRHKPITISKRLLRERTVFYTSSLDESEGDADSFSKVRPPGEKPTIIRPPVRPPDPPCRAATPQKPEPKPDIVAGNAGEITSSVVASRTRFFETASRKTGSSQGRLPGDES

SEQ ID NO: 56522 - protein, 74 aa, Homo sapiens
MLELLIRHLVNVCEHSKENLMTPSNMGVIFGPTLMRAQEDTVAAMMNIKFQNIVVEILIEHFGKISSFFLHRSI

SEQ ID NO: 56523 - protein, 1036 aa, Homo sapiens
MASSVGNVADSTGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 56524 - protein, 1046 aa, Homo sapiens
MASSVGNVADSTEPTKRMLSFQGLAELAHREYQAGDFEAAERHCMQLWRQEPDNTGVLLLLSSIHFQCRRLDRSAHFSTLAIKQNPLLAEAYSNLGNVYKERGQLQEAIEHYRHALRLKPDFIDGYINLAAALVAAGDMEGAVQAYVSALQYNPDLYCVRSDLGNLLKALGRLEEAKACYLKAIETQPNFAVAWSNLGCVFNAQGEIWLAIHHFEKAVTLDPNFLDAYINLGNVLKEARIFDRAVAAYLRALSLSPNHAVVHGNLACVYYEQGLIDLAIDTYRRAIELQPHFPDAYCNLANALKEKGSVAEAEDCYNTALRLCPTHADSLNNLANIKREQGNIEEAVRLYRKALEVFPEFAAAHSNLASVLQQQGKLQEALMHYKEAIRISPTFADAYSNMGNTLKEMQDVQGALQCYTRAIQINPAFADAHSNLASIHKDSGNIPEAIASYRTALKLKPDFPDAYCNLAHCLQIVCDWTDYDERMKKLVSIVADQLEKNRLPSVHPHHSMLYPLSHGFRKAIAERHGNLCLDKINVLHKPPYEHPKDLKLSDGRLRVGYVSSDFGNHPTSHLMQSIPGMHNPDKFEVFCYALSPDDGTNFRVKVMAEANHFIDLSQIPCNGKAADRIHQDGIHILVNMNGYTKGARNELFALRPAPIQAMWLGYPGTSGALFMDYIITDQETSPAEVAEQYSEKLAYMPHTFFIGDHANMFPHLKKKAVIDFKSNGHIYDNRIVLNGIDLKAFLDSLPDVKIVKMKCPDGGDNADSSNTALNMPVIPMNTIAEAVIEMINRGQIQITINGFSISNGLATTQINNKAATGEEVPRTIIVTTRSQYGLPEDAIVYCNFNQLYKIDPSTLQMWANILKRVPNSVLWLLRFPAVGEPNIQQYAQNMGLPQNRIIFSPVAPKEEHVRRGQLADVCLDTPLCNGHTTGMDVLWAGTPMVTMPGETLASRVAASQLTCLGCLELIAKNRQEYEDIAVKLGTDLEYLKKVRGKVWKQRISSPLFNTKQYTMELERLYLQMWEHYAAGNKPDHMIKPVEVTESA

SEQ ID NO: 56525 - protein, 109 aa, Homo sapiens
MSITDVLSADDIAAALQECRDPDTFEPQKFFQTSGLSKMSANQVKDVFRFIDNDQSGYLDEEELKFFLQKFESGARELTESETKSLMAAADNDGDGKIGAEEFQEMVHS

SEQ ID NO: 56526 - protein, 109 aa, Homo sapiens; identical to SEQ ID NO: 56525

SEQ ID NO: 56527 - protein, 545 aa, Homo sapiens
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDVVNDKIVASNLVTGLPKQTPGSSGDFIIRTSKLLIPVTCEFPRLYTISEGYVPNLRNSPLEIMSRNHGIFPFTLEIFKDNEFEEPYREALPTLKLRDSLYFGIEPVVHVSGLESLVESCFATPTSKIDEVLKYYLIRDGCVSDDSVKQYTSRDHLAKHFQVPVFKFVGKDHKEVFLHCRVLVCGVLDERSRCAQGCHRRMRRGAGGEDSAGLQGQTLTGGPIRIDWED

SEQ ID NO: 56528 - protein, 321 aa, Homo sapiens
MPPFLLLTCLFITGTSVSPVALDPCSAYISLNEPWRNTDHQLDESQGPPLCDNHVNGEWYHFTGMAGDAMPTFCIPENHCGTHAPVWLNGSHPLEGDGIVQRQACASFNGNCCLWNTTVEVKACPGGYYVYRLTKPSVCFHVYCGHFYDICDEDCHGSCSDTSECTCAPGTVLGPDRQTCFDENECEQNNGGCSEICVNLKNSYRCECGVGRVLRSDGKTCEDVEGCHNNNGGCSHSCLGSEKGYQCECPRGLVLSEDNHTCQVPVLCKSNAIEVNIPRELVGGLELFLTNTSCRGVSNGTHVNILFSLKTCGTVVDSCFQ

SEQ ID NO: 56529 - protein, 252 aa, Homo sapiens
MGVLLTQRTLLSLVLALLFPSMASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 56530 - protein, 231 aa, Homo sapiens
MASMAAIGSCSKEYRVLLGQLQKQTDLMQDTSRLLDPYIRIQGLDVPKLREHCRERPGAFPSEETLRGLGRRGFLQTLNATLGCVLHRLADLEQRLPKAQDLERSGLNIEDLEKLQMARPNILGLRNNIYCMAQLLDNSDTAEPTKAGRGASQPPTPTPASDAFQRKLEGCRFLHGYHRFMHSVGRVFSKWGESPNRSRRHSPHQALRKGVRRTRPSRKGKRLMTRGQLPR

SEQ ID NO: 56531 - protein, 979 aa, Homo sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRVYLMNPFSVNFENVNATNAIMTWKVHSIRNNFTYLCQIELHGEGKMMQYNVSIKVNGEYFLSELEPATEYMARVRCADASHFWKWSEWSGQNFTTLEAAPSEAPDVWRIVSLEPGNHTVTLFWKPLSKLHANGKILFYNVVVENLDKPSSSELHSIPAPANSTKLILDRCSYQICVIANNSVGASPASVIVISADPENKEVEEERIAGTEGGFSLSWKPQPGDVIGYVVDWCDHTQDVLGDFQWKNVGPNTTSTVISTDAFRPGVRYDFRIYGLSTKRIACLLEKKTGYSQELAPSDNPHVLVDTLTSHSFTLSWKDYSTESQPGFIQGYHVYLKSKARQCHPRFEKAVLSDGSECCKYKIDNPEEKALIVDNLKPESFYEFFITPFTSAGEGPSATFTKVTTPDEHSSMLIHILLPMVFCVLLIMVMCYLKSQWIKETCYPDIPDPYKSSILSLIKFKENPHLIIMNVSDCIPDAIEVVSKPEGTKIQFLGTRKSLTETELTKPNYLYLLPTEKNHSGPGPCICFENLTYNQAASDSGSCGHVPVSPKAPSMLGLMTSPENVLKALEKNYMNSLGEIPAGETSLNYVSQLASPMFGDKDSLPTNPVEAPHCSEYKMQMAVSLRLALPPPTENSSLSSITLLDPGEHYC

SEQ ID NO: 56532 - protein, 342 aa, Homo sapiens
MALFAVFQTTFFLTLLSLRTYQSEVLAERLPLTPVSLKVSTNSTRQSLHLQWTVHNLPYHQELKMVFQIQISRIETSNVIWVGNYSTTVKWNQVLHWSWESELPLECATHFVRIKSLVDDAKFPEPNFWSNWSSWEEVSVQDSTGQDILFVFPKDKLVEEGTNVTICYVSRNIQNNVSCYLEGKQIHGEQLDPHVTAFNLNSVPFIRNKGTNIYCEASQGNVSEGMKGIVLFVSKVLEEPKDFSCETEDFKTLHCTWDPGTDTALGWSKQPSQSYTLFESFSGEKKLCTHKNWCNWQITQDSQETYNFTLIAENYLRKRSVNILFNLTHRGETRVVTAHRGH

SEQ ID NO: 56533 - protein, 465 aa, Homo sapiens
MNAQLTMEAIGELHGVSHEPVPAPADLLGGSPHARSSVAHRGSHLPPAHPRSMGMASLLDGGSGGGDYHHHHRAPEHSLAGPLHPTMTMACETPPGMSMPTTYTTLTPLQPLPPISTVSDKFPHHHHHHHHHHHPHHHQRLAGNVSGSFTLMRDERGLASMNNLYTPYHKDVAGMGQSLSPLSSSGLGSIHNSQQGLPHYAHPGAAMPTDKMLTPNGFEAHHPAMLGRHGEQHLTPTSAGMVPINGLPPHHPHAHLNAQGHGQLLGTAREPNPSVTGAQVSNGSNSGQMEEINTKEVAQRITTELKRYSIPQAIFAQRVLCRSQGTLSDLLRNPKPWSKLKSGRETFRRMWKWLQEPEFQRMSALRLAACKRKEQEHGKDRGNTPKKPRLVFTDVQRRTLHAIFKENKRPSKELQITISQQLGLELSTVSNFFMNARRRSLDKWQDEGSSNSGNSSSSSSTCTKA

SEQ ID NO: 56534 - protein, 504 aa, Homo sapiens
MKAAYTAYRCLTKDLEGCAMNPELTMESLGTLHGPAGGGSGGGGGGGGGGGGGGPGHEQELLASPSPHHAGRGAAGSLRGPPPPPTAHQELGTAAAAAAAASRSAMVTSMASILDGGDYRPELSIPLHHAMSMSCDSSPPGMGMSNTYTTLTPLQPLPPISTVSDKFHHPHPHHHPHHHHHHHHQRLSGNVSGSFTLMRDERGLPAMNNLYSPYKEMPGMSQSLSPLAATPLGNGLGGLHNAQQSLPNYGPPGHDKMLSPNFDAHHTAMLTRGEQHLSRGLGTPPAAMMSHLNGLHHPGHTQSHGPVLAPSRERPPSSSSGSQVATSGQLEEINTKEVAQRITAELKRYSIPQAIFAQRVLCRSQGTLSDLLRNPKPWSKLKSGRETFRRMWKWLQEPEFQRMSALRLAACKRKEQEPNKDRNNSQKKSRLVFTDLQRRTLFAIFKENKRPSKEMQITISQQLGLELTTVSNFFMNARRRSLEKWQDDLSTGGSSSTSSTCTKA

SEQ ID NO: 56535 - protein, 485 aa, Homo sapiens [sequence omitted]

SEQ ID NO: 56536 - protein, 149 aa, Homo sapiens
MVDDAGAAESQRGKQTPAHSLEQLRRLPLPPPQIRIRPWWFPVQELRDPLVFYLEAWLADELFGPDRAIIPEMEWTSQALLTVDIVDSGNLVEITVFGRPRVQNRVKSMLLCLAWFHREHRARAEKMKHLEKNLKAHASDPHSPQDPVA

SEQ ID NO: 56537 - protein, 372 aa, Homo sapiens
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVPILIITVCYGLMLLRLRSVRLLSGSKEKDRSLRRITRMVLVVVGAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 56538 - protein, 324 aa, Homo sapiens
MEPAPSAGAELQPPLFANASDAYPSACPSAGANASGPPGARSASSLALAIAITALYSAVCAVGLLGNVLVMFGIVRYTKMKTATNIYIFNLALADALATSTLPFQSAKYLMETWPFGELLCKAVLSIDYYNMFTSIFTLTMMSVDRYIAVCHPVKALDFRTPAKAKLINICIWVLASGVGVPIMVMAVTRPRDGAVVCMLQFPSPSWYWDTVTKICVFLFAFVVCWAPIHIFVIVWTLVDIDRRDPLVVAALHLCIALGYANSSLNPVLYAFLDENFKRCFRQLCRKPCGRPDPSSFSRAREATARERVTACTPSDGPGGGAAA

SEQ ID NO: 56539 - protein, 380 aa, Homo sapiens
MDSPIQIFRGEPGPTCAPSACLPPNSSAWFPGWAEPDSNGSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 56540 - protein, 366 aa, Homo sapiens
MDSPIQIFRGEPGPTCAPSACLPPNSSAGSEDAQLEPAHISPAIPVIITAVYSVVFVVGLVGNSLVMFVIIRYTKMKTATNIYIFNLALADALVTTTMPFQSTVYLMNSWPFGDVLCKIVISIDYYNMFTSIFTLTMMSVDRYIAVCHPVKALDFRTPLKAKIINICIWLLSSSVGISAIVLGGTKVREDVDVIECSLQFPDDDYSWWDLFMKICVFIFAFVIPVLIIIVCYTLMILRLKSVRLLSGSREKDRNLRRITRLVLVVVAVFVVCWTPIHIFILVEALGSTSHSTAALSSYYFCIALGYTNSSLNPILYAFLDENFKRCFRDFCFPLKMRMERQSTSRVRNTVQDPAYLRDIDGMNKPV

SEQ ID NO: 56541 - protein, 380 aa, Homo sapiens; identical to SEQ ID NO: 56539

SEQ ID NO: 56542 - protein, 446 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQCLPIPSLSCWALEQGCLVVYPGPLQGPLVRYDLPAILHSSCLRGNTAPSPSGGAFLLS

SEQ ID NO: 56543 - protein, 400 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 56544 - protein, 418 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQPPLAVSMAQIFTRYPPPTHREKTCNDYMKR

SEQ ID NO: 56545 - protein, 402 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQIRDPISNLPRVSVF

SEQ ID NO: 56546 - protein, 403 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQGPPAKFVADQLAGSS

SEQ ID NO: 56547 - protein, 420 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQVELNLDCHCENAKPWPLSYNAGQSPFPFPGRV

SEQ ID NO: 56548 - protein, 392 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQVRSL

SEQ ID NO: 56549 - protein, 493 aa, Homo sapiens
MCLHRRVPSEETYSLDRFAQNPPLFPPPSLPASESRMAHAPLLQRCGAARTGFCKKQQELWQRRKEAAEALGTRKVSVLLATSHSGARPAVSTMDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 56550 - protein, 397 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQRERRQKSDW

SEQ ID NO: 56551 - protein, 406 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQKIDLFQKSSLLNCEHTKG

SEQ ID NO: 56552 - protein, 319 aa, Homo sapiens
MMRAKSISTKAGKPSRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 56553 - protein, 402 aa, Homo sapiens; identical to SEQ ID NO: 56545

SEQ ID NO: 56554 - protein, 163 aa, Homo sapiens [sequence omitted]

SEQ ID NO: 56555 - protein, 300 aa, Homo sapiens
MKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQLENLEAETAPLP

SEQ ID NO: 56556 - protein, 300 aa, Homo sapiens; identical to SEQ ID NO: 56555

SEQ ID NO: 56557 - protein, 300 aa, Homo sapiens; identical to SEQ ID NO: 56555

SEQ ID NO: 56558 - protein, 402 aa, Homo sapiens; identical to SEQ ID NO: 56545

SEQ ID NO: 56559 - protein, 186 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRFHRLYTNILSSNLVLGKPAEDLCFHLRLHYASAHHYRVLWTDDLAPQECPHALWLQRKGQESSKDHQDGAGGGGCVHRLLDSHSHLRHH

SEQ ID NO: 56560 - protein, 389 aa, Homo sapiens
MDSSAAPTNASNCTDALAYSSCSPAPSPGSWVNLSHLDGNLSDPCGPNRTDLGGRDSLCPPTGSPSMITAITIMALYSIVCVVGLFGNFLVMYVIVRYTKMKTATNIYIFNLALADALATSTLPFQSVNYLMGTWPFGTILCKIVISIDYYNMFTSIFTLCTMSVDRYIAVCHPVKALDFRTPRNAKIINVCNWILSSAIGLPVMFMATTKYRQGSIDCTLTFSHPTWYWENLLKICVFIFAFIMPVLIITVCYGLMILRLKSVRMLSGSKEKDRNLRRITRMVLVVVAVFIVCWTPIHIYVIIKALVTIPETTFQTVSWHFCIALGYTNSCLNPVLYAFLDENFKRCFREFCIPTSSNIEQQNSTRIRQNTRDHPSTANTVDRTNHQS

SEQ ID NO: 56561 - protein, 364 aa, Homo sapiens
MAQQWSLQRLAGRHPQDSYEDSTQSSIFTYTNSNSTRGPFEGPNYHIAPRWVYHLTSVWMIFVVTASVFTNGLVLAATMKFKKLRHPLNWILVNLAVADLAETVIASTISIVNQVSGYFVLGHPMCVLEGYTVSLCGITGLWSLAIISWERWLVVCKPFGNVRFDAKLAIVGIAFSWIWSAVWTAPPIFGWSRYWPHGLKTSCGPDVFSGSSYPGVQSYMIVLMVTCCIIPLAIIMLCYLQVWLAIRAVAKQQKESESTQKAEKEVTRMVVVMIFAYCVCWGPYTFFACFAAANPGYAFHPLMAALPAYFAKSATIYNPVIYVFMNRQFRNCILQLFGKKVDDGSELSSASKTEVSSVSSVSPA

SEQ ID NO: 56562 - protein, 364 aa, Homo sapiens
MAQQWSLQRLAGRHPQDSYEDSTQSSIFTYTNSNSTRGPFEGPNYHIAPRWVYHLTSVWMIFVVIASVFTNGLVLAATMKFKKLRHPLNWILVNLAVADLAETVIASTISVVNQVYGYFVLGHPMCVLEGYTVSLCGITGLWSLAIISWERWMVVCKPFGNVRFDAKLAIVGIAFSWIWAAVWTAPPIFGWSRYWPHGLKTSCGPDVFSGSSYPGVQSYMIVLMVTCCITPLSIIVLCYLQVWLAIRAVAKQQKESESTQKAEKEVTRMVVVMVLAFCFCWGPYAFFACFAAANPGYPFHPLMAALPAFFAKSATIYNPVIYVFMNRQFRNCILQLFGKKVDDGSELSSASKTEVSSVSSVSPA

SEQ ID NO: 56563 - protein, 348 aa, Homo sapiens
MRKMSEEEFYLFKNISSVGPWDGPQYHIAPVWAFYLQAAFMGTVFLIGFPLNAMVLVATLRYKKLRQPLNYILVNVSFGGFLLCIFSVFPVFVASCNGYFVFGRHVCALEGFLGTVAGLVTGWSLAFLAFERYIVICKPFGNFRFSSKHALTVVLATWTIGIGVSIPPFFGWSRFIPEGLQCSCGPDWYTVGTKYRSESYTWFLFIFCFIVPLSLICFSYTQLLRALKAVAAQQQESATTQKAEREVSRMVVVMVGSFCVCYVPYAAFAMYMVNNRNHGLDLRLVTIPSFFSKSACIYNPIIYCFMNKQFQACIMKMVCGKAMTDESDTCSSQKTEVSTVSSTQVGPN

SEQ ID NO: 56564 - protein, 323 aa, Homo sapiens
MYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGWISQLQAATREARASMGPVQQGTICMQLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 56565 - protein, 402 aa, Homo sapiens
MYSGNRSGGHGYWDGGGAAGAEGPAPAGTLSPAPLFSPGTYERLALLLGSIGLLGVGNNLLVLVLYYKFQRLRTPTHLLLVNISLSDLLVSLFGVTFTFVSCLRNGWVWDTVGCVWDGFSGSLFGIVSIATLTVLAYERYIRVVHARVINFSWAWRAITYIWLYSLAWAGAPLLGWNRYILDVHGLGCTVDWKSKDANDSSFVLFLFLGCLVVPLGVIAHCYGHILYSIRMLRCVEDLQTIQVIKILKYEKKLAKMCFLMIFTFLVCWMPYIVICFLVVNGHGHLVTPTISIVSYLFAKSNTVYNPVIYVFMIRKFRRSLLQLLCLRLLRCQRPAKDLPAAGSEMQIRPIVMSQKDGDRPKKKVTFNSSSIIFIITSDESLSVDDSDKTNGSKVDVIQVRPL

SEQ ID NO: 56566 - protein, 961 aa, Homo sapiens
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 56567 - protein, 1015 aa, Homo sapiens
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGHKLVSEVIGASDLLLLLGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 56568 - protein, 979 aa, Homo sapiens
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFGHKLVSEVIGASDLLLLLGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 56569 - protein, 978 aa, Homo sapiens
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGHKLVSEVIGASDLLLLLGSPEETAFRATDRGSESDKHFRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 56570 - protein, 997 aa, Homo sapiens
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKGLLGELILLQQQIQEHEEEARRAAGQYSTSYAQQKRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 56571 - protein, 166 aa, Homo sapiens
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFGSPEETAFRATDRGSES

SEQ ID NO: 56572 - protein, 960 aa, Homo sapiens
MWRLRRAAVACEVCQSLVKHSSGIKGSLPLQKLHLVSRSIYHSHHPTLKLQRPQLRTSFQQFSSLTNLPLRKLKFSPIKYGYQPRRNFWPARLATRLLKLRYLILGSAVGGGYTAKKTFDQWKDMIPDLSEYKWIVPDIVWEIDEYIDFEKIRKALPSSEDLVKLAPDFDKIVESLSLLKDFFTSGSPEETAFRATDRGSESDKHFRKVSDKEKIDQLQEELLHTQLKYQRILERLEKENKELRKLVLQKDDKGIHHRKLKKSLIDMYSEVLDVLSDYDASYNTQDHLPRVVVVGDQSAGKTSVLEMIAQARIFPRGSGEMMTRSPVKVTLSEGPHHVALFKDSSREFDLTKEEDLAALRHEIELRMRKNVKEGCTVSPETISLNVKGPGLQRMVLVDLPGVINTVTSGMAPDTKETIFSISKAYMQNPNAIILCIQDGSVDAERSIVTDLVSQMDPHGRRTIFVLTKVDLAEKNVASPSRIQQIIEGKLFPMKALGYFAVVTGKGNSSESIEAIREYEEEFFQNSKLLKTSMLKAHQVTTRNLSLAVSDCFWKMVRESVEQQADSFKATRFNLETEWKNNYPRLRELDRNELFEKAKNEILDEVISLSQVTPKHWEEILQQSLWERVSTHVIENIYLPAAQTMNSGTFNTTVDIKLKQWTDKQLPNKAVEVAWETLQEEFSRFMTEPKGKEHDDIFDKLKEAVKEESIKRHKWNDFAEDSLRVIQHNALEDRSISDKQQWDAAIYFMEEALQARLKDTENAIENMVGPDWKKRWLYWKNRTQEQCVHNETKNELEKMLKCNEEHPAYLASDEITTVRKNLESRGVEVDPSLIKDTWHQVYRRHFLKTALNHCNLCRRGFYYYQRHFVDSELECNDVVLFWRIQRMLAITANTLRQQLTNTEVRRLEKNVKEVLEDFAEDGEKKIKLLTGKRVQLAEDLKKVREIQEKLDAFIEALHQEK

SEQ ID NO: 56573 - protein, 185 aa, Homo sapiens
  MOD_RES (1)..(1): Any amino acid
XYLILGSAVGGGYTAKKTFDQWKDMIPDLSEYKWIVPDIVWEIDEYIDFEKIRKALPSSEDLVKLAPDFDKIVESLSLLKDFFTSGHKLVSEVIGASDLLLLLGSPEETAFRATDRGSESDKHFRKVSDKEKIDQLQEELLHTQLKYQRILERLEKENKELRKLVLQKDDKGIHHRKLKKSLIDM

SEQ ID NO: 56574 - protein, 179 aa, Homo sapiens
MVVGAFPMAKLLYLGIRQVSKPLANRIKEAARRSEFFKTYICLPPAQLYHWVEMRTKMRIMGFRGTVIKPLNEEAAAELGAELLGEATIFIVGGGCLVLEYWRHQAQQRHKEEEQRAAWNALRDEVGHLALALEALQAQVQAAPPQGALEELRTELQEVRAQLCNPGRSASHAVPASKK

SEQ ID NO: 56575 - protein, 180 aa, Homo sapiens
MVVGAFPMAKLLYLGIRQVSKPLANRIKEAARRSEFFKTYICLPPAQLYHWLEMRTKMRIMGFNAAAIKPLNEGAAAELGAELLGEGIIFITACSCLMLEYWRHQLQQRRKEKERRVAREALRGEVGHLGLALEELQAQVQATSTQLALEELRAQLQEVRAHLCLRDPPPAPPVAPASEK

SEQ ID NO: 56576 - protein, 126 aa, Homo sapiens
MRTKMRIMGFRGTVIKPLNEEAAAELGAELLGEATIFIVGGGCLVLEYWRHQAQQRHKEEEQRAAWNALRDEVGHLALALEALQAQVQAAPPQGALEELRTELQEVRAQLCNPGRSASHAVPASKK

SEQ ID NO: 56577 - protein, 577 aa, Homo sapiens [sequence omitted]

SEQ ID NO: 56578 - protein, 577 aa, Homo sapiens [sequence omitted]

SEQ ID NO: 56579 - protein, 577 aa, Homo sapiens [sequence omitted]

SEQ ID NO: 56580 - protein, 571 aa, Homo sapiens
MSHQPLSCLTEKEDSPSESTGNGPPHLAHPNLDTFTPEELLQQMKELLTENHQLKEAMKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRTVSTGTSRSADGAKNYFEHEELTVSQLLLCLREGNQKVERLEVALKEAKERVSDFEKKTSNRSEIETQTEGSTEKENDEEKGPETVGSEVEALNLQVTSLFKELQEAHTKLSKAELMKKRLQEKCQALERKNSAIPSELNEKQELVYTNKKLELQVESMLSEIKMEQAKTEDEKSKLTVLQMTHNKLLQEHNNALKTIEELTRKESEKVDRAVLKELSEKLELAEKALASKQLQMDEMKQTIAKQEEDLETMTILRAQMEVYCSDFHAERAAREKIHEEKEQLALQLAVLLKENDAFEDGGRQSLMEMQSRHGARTSDSDQQAYLVQRGAEDRDWRQQRNIPIHSCPKCGEVLPDIDTLQIHVMDCII

SEQ ID NO: 56581 - protein, 577 aa, Homo sapiens [sequence omitted]

SEQ ID NO: 56582 - protein, 571 aa, Homo sapiens; identical to SEQ ID NO: 56580

SEQ ID NO: 56583 - protein, 126 aa, Homo sapiens
  MOD_RES (1)..(1): Any amino acid
XGEAEGSVKEIKHSPGPTRTVSTGTALSKYRSRSADGAKNYFEHEELTVSQLLLCLREGNQKVERLEVALKEAKERVSDFEKKTSNRSEIETQTEGSTEKENDEEKGPETTGFHHVGQDGLDLLTS

SEQ ID NO: 56584 - protein, 147 aa, Homo sapiens
MKLNNQAMKGRFEELSAWTEKQKEERQFFEIQSKEAKERLMALSHENEKLKEELGKLKGKSERSSEDPTDDSRLPRAEAEQEKDQLRTQVVRLQAEKADLLGIVSELQLKLNSSGSSEDSFVEIRMAEGEAEGSVKEIKHSPGPTRT

SEQ ID NO: 56585 - protein, 303 aa, Homo sapiens
MHPEPAPPPSRSSPELPPSGGSTTSGSRRSRRRSGDGEPPGAPPPPPPPSAVTYPDWIGQSYSEVMSLNEHSMQALSWRKLYLSRAKLKASSRTSALLSGFAMVAMVEVQLDADHDYPPGLLIAFSACTTVLVAVHLFALMISTCILPNIEAVSNVHNLNSVKESPHERMHRHIELAWAFSTVIGTLLFLAEVVLLCWVKFLPLKKQPGQPRPTSKPPASGAAANVSTSGITPGQAAAIASTTIMVPFGLIFIVFAVHFYRSLVSHKTDRQFQELNELAEFARLQDQLDHRGDHPLTPGSHYA

SEQ ID NO: 56586 - protein, 254 aa, Homo sapiens
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTERHNREIEELHKLKVQLDGHERSLQVL

SEQ ID NO: 56587 - protein, 254 aa, Homo sapiens; identical to SEQ ID NO: 56586

SEQ ID NO: 56588 - protein, 212 aa, Homo sapiens
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFV

SEQ ID NO: 56589 - protein, 254 aa, Homo sapiens; identical to SEQ ID NO: 56586

SEQ ID NO: 56590 - protein, 254 aa, Homo sapiens; identical to SEQ ID NO: 56586

SEQ ID NO: 56591 - protein, 30 aa, Homo sapiens
MSAELNVPIDPSAPACPEPGHKGMDYRDWV

SEQ ID NO: 56592 - protein, 229 aa, Homo sapiens
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAFSACTTVLVAVHLFALLISTCILPNVEAVSNIHNLNSISESPHERMHPYIELAWGFSTVLGILLFLAEVVLLCWIKFLPVDARRQPGPPPGPGSHTGWQAALVSTIIMVPVGLIFVVFTIHFYRSLVRHKTER

SEQ ID NO: 56593 - protein, 97 aa, Homo sapiens
MSAELNVPIDPSAPACPEPGHKGMDYRDWVRRSYLELVTSNHHSVQALSWRKLYLSRAKLKASSRTSALLSGFAMVAMVEVQLETQYQYPRPLLIAF

SEQ ID NO: 56594 - protein, 295 aa, Homo sapiens [sequence omitted]

SEQ ID NO: 56595 - protein, 273 aa, Homo sapiens
MKGGEGDAGEQAPLNPEGESPAGSATYREFVHRGYLDLMGASQHSLRALSWRRLYLSRAKLKASSRTSALLSGFAMVAMVEVQLESDHEYPPGLLVAFSACTTVLVAVHLFALMVSTCLLPHIEAVSNIHNLNSVHQSPHQRLHRYVELAWGFSTALGTFLFLAEVVLVGWVKFVPIGAPLDTPTPMVPTSRVPGTLAPVATSLSPASNLPRSSASAAPSQAEPACPPRQACGGGGAHGPGWQAAMASTFPGIFPISLSLGFCKLLCTWAGLS

SEQ ID NO: 56596 - protein, 137 aa, Homo sapiens
MAGSQDIFDAIVMADERFHGEGYREGYEEGSSLGVMEGRQHGTLHGAKIGSEIGCYQGFAFAWKCLLHSCTTEKDSRKMKVLESLIGMIQKFPYDDPTYDKLHEDLDKIRGKFKQFCSLLNVQPDFKISAEGSGLSF

SEQ ID NO: 56597 - protein, 221 aa, Homo sapiens
MAGSQDIFDAIVMADERFHGEGYREGYEEGSSLGVMEGRQHGTLHGAKIGSEIGCYQGFAFAWKCLLHSCTTEKDSRKMKVLESLIGMIQKFPYDDPTYDKLHEDLDKIRGKFKQTGLSPSAVMVRPPSYVELPVTCWCWEAPRCNQKCTDPAARRPDPQTCASQDRLRCAPCTCHQPLASRYTQHPGLVPLPHHDRQSVPQGPRVVQTDAAARMVEQQTM

SEQ ID NO: 56598 - protein, 137 aa, Homo sapiens; identical to SEQ ID NO: 56596

SEQ ID NO: 56599 - protein, 78 aa, Homo sapiens
MAGSQDIFDAIVMADESRKMKVLESLIGMIQKFPYDDPTYDKLHEDLDKIRGKFKQFCSLLNVQPDFKISAEGSGLSF

SEQ ID NO: 56600 - protein, 1012 aa, Homo sapiens
MMAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLKYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 56601 - protein, 972 aa, Homo sapiens
MMAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 56602 - protein, 872 aa, Homo sapiens
MHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLKYQLELKDDYIIRTNRLIEDERKNKEKAVHLQEELIAINSKKEELNQSVNRVKELELELESVKAQSLAITKQNHMLNEKVKEMSDYSLLKEEKLELLAQNKLLKQQLEESRNENLRLLNRLAQPAPELAVFQKELRKAEKAIVVEHEEFESCRQALHKQLQDEIEHSAQLKAQILGYKASVKSLTTQVADLKLQLKQTQTALENEVYCNPKQSVIDRSVNGLINGNVVPCNGEISGDFLNNPFKQENVLARMVASRITNYPTAWVEGSSPDSDLEFVANTKARVKELQQEAERLEKAFRSYHRRVIKNSAKSPLAAKSPPSLHLLEAFKNITSSSPERHIFGEDRVVSEQPQVGTLEERNDVVEALTGSAASRLRGGTSSRRLSSTPLPKAKRSLESEMYLEGLGRSHIASPSPCPDRMPLPSPTESRHSLSIPPVSSPPEQKVGLYRRQTELQDKSEFSDVDKLAFKDNEEFESSFESAGNMPRQLEMGGLSPAGDMSHVDAAAAAVPLSYQHPSVDQKQIEEQKEEEKIREQQVKERRQREERRQSNLQEVLERERRELEKLYQERKMIEESLKIKIKKELEMENELEMSNQEIKDKSAHSENPLEKYMKIIQQEQDQESADKSSKKMVQEGSLVDTLQSSDKVESLTGFSHEELDDSW

SEQ ID NO: 56603 - protein, 367 aa, Homo sapiens
MMAQSNMFTVADVLSQDELRKKLYQTFKDRGILDTLKTQLRNQLIHELMHPVLSGELQPRSISVEGSSLLIGASNSLVADHLQRCGYEYSLSVFFPESGLAKEKVFTMQDLLQLIKINPTSSLYKSLVSGSDKENQKGFLMHFLKELAEYHQAKESCNMETQTSSTFNRDSLAEKLQLIDDQFADAYPQRIKFESLEIKLNEYKREIEEQLRAEMCQKLKFFKDTEIAKIKMEAKKKYEKELTMFQNDFEKACQAKSEALVLREKSTLERIHKHQEIETKEIYAQRQLLLKDMDLLRGREAELKQRVEAFELNQKLQEEKHKSITEALRRQEQNIKSFEETYDRKLKNELLNFHRLHGVCLALGILI

SEQ ID NO: 56604 - protein, 338 aa, Homo sapiens [sequence omitted]

SEQ ID NO: 56605 - protein, 861 aa, Homo sapiens
MAHYPTRLKTRKTYSWVGRPLLDRKLHYQTYREMCVKTEGCSTEIHIQIGQFVLIEGDDDENPYVAKLLELFEDDSDPPPKKRARVQWFVRFCEVPACKRHLLGRKPGAQEIFWYDYPACDSNINAETIIGLVRVIPLAPKDVVPTNLKNEKTLFVKLSWNEKKFRPLSSELFAELNKPQESAAKCQKPVRAKSKSAESPSWTPAEHVAKRIESRHSASKSRQTPTHPLTPRARKRLELGNLGNPQMSQQTSCASLDSPGRIKRKVAFSEITSPSKRSQPDKLQTLSPALKAPEKTRETGLSYTEDDKKASPEHRIILRTRIAASKTIDIREERTLTPISGGQRSSVVPSVILKPENIKKRDAKEAKAQNEATSTPHRIRRKSSVLTMNRIRQQLRFLGNSKSDQEEKEILPAAEISDSSSDEEEASTPPLPRRAPRTVSRNLRSSLKSSLHTLTKVPKKSLKPRTPRCAAPQIRSRSLAAQEPASVLEEARLRLHVSAVPESLPCREQEFQDIYNFVESKLLDHTGGCMYISGVPGTGKTATVHEVIRCLQQAAQANDVPPFQYIEVNGMKLTEPHQVYVQILQKLTGQKATANHAAELLAKQFCTRGSPQETTVLLVDELDLLWTHKQDIMYNLFDWPTHKEARLVVLAIANTMDLPERIMMNRVSSRLGLTRMCFQPYTYSQLQQILRSRLKHLKAFEDDAIQLVARKVAALSGDARRCLDICRRATEICEFSQQKPDSPGLVTIAHSMEAVDEMFSSSYITAIKNSSVLEQSFLRAILAEFRRSGLEEATFQQIYSQHVALCRMEGLPYPTMSETMAVCSHLGSCRLLLVEPSRNDLLLRVRLNVSQDDVLYALKDE

SEQ ID NO: 56606 - protein, 861 aa, Homo sapiens; identical to SEQ ID NO: 56605

SEQ ID NO: 56607 - protein, 577 aa, Homo sapiens
MSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKLASELAKTPQKSVSFSLKNDPEITINVPQSSKGHSASDKVQPKNNDKSEFLSTAPRSLRKRLIVPRSHSDSESEYSASNSEDDEGVAQEHEEDTNAVIFSQKIQAQNRVVSAPVGKETPSKRMKRDKTSDLVEEYFEAHSSSKVLTSDRTLQKLKRAKLDQQTLRNLLSKVSPSFSAELKQLNQQYEKLFHKWMLQLHLGFNIVLYGLGSKRDLLERFRTTMLQDSIHVVINGFFPGISVKSVLNSITEEVLDHMGTFRSILDQLDWIVNKFKEDSSLELFLLIHNLDSQMLRGEKSQQIIGQLSSLHNIYLIASIDHLNAPLMWDHAKQSLFNWLWYETTTYSPYTEETSYENSLLVKQSGSLPLSSLTHVLRSLTPNARGIFRLLIKYQLDNQDNPSYIGLSFQDFYQQCREAFLVNSDLTLRAQLTEFRDHKLIRTKKGTDGVEYLLIPVDNGTLTDFLEKEEEEA

SEQ ID NO: 56608 - protein, 109 aa, Homo sapiens
MSKPELKEDKMLEVHFVGDDDVLNHILDREGGAKLKKERAQLLVNPKKIIKKPEYDLEEDDQEVLKDQNYVEIMGRDVQESLKNGSATGGGNKVYSFQNRKHSEKMAKL

SEQ ID NO: 56609 - protein, 72 aa, Homo sapiens
MSKPELKEDKMLEVHFVGDDDVLNHILDREGGAKLKKERAQLLVNPKKIIKKPEYDLEEDDQEVLKDQNYVE

SEQ ID NO: 56610 - protein, 712 aa, Homo sapiens
MATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDAETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 56611 - protein, 711 aa, Homo sapiens
MATSSMSKGCFVFKPNSKKRKISLPIEDYFNKGKNEPEDSKLRFETYQLIWQQMKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 56612 - protein, 444 aa, Homo sapiens
MKSENERLQEELNKNLFDNLIEFLQKSHSGFQKNSRDLGGQIKLREIPTAALVLGVNVTDHDLTFGSLTEALQNNVTPYVVSLQAKDCPDMKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRLGLAFLDIQLFGAQSGQELLLPLSWEANPSHAANLG

SEQ ID NO: 56613 - protein, 568 aa, Homo sapiens
MKHFLQKLISQLMDCCVDIKSKEEESVHVTQRKTHYSMDSLSSWYMTVTQKTDPKMLSKKRTTSSQWQSPPVVVILKDMESFATKVLQDFIIISSQHLHEFPLILIFGIATSPIIIHRLLPHAVSSLLCIELFQSLSCKEHLTTVLDKLLLTTQFPFKINEKVLQVLTNIFLYHDFSVQNFIKGLQLSLLEHFYSQPLSVLCCNLPEAKRRINFLSNNQCENIRRLPSFRRYVEKQASEKQVALLTNERYLKEETQLLLENLHVYHMNYFLVLRCLHKFTSSLPKYPLGRQIRELYCTCLEKNIWDSEEYASVLQLLRMLAKDELMTILEKCFKVFKSYCENHLGSTAKRIEEFLAQFQSLDETKEEEDASGSQPKGLQKTDLYHLQKSLLEMKELRRSKKQTKFEVLRENVVNFIDCLVREYLLPPETQPLHEVVYFSAAHALREHLNAAPRIALHTALNNPYYYLKNEALKSEEGCIPNIAPDICIAYKLHLECSRLINLVDWSEAFATVVTAAEKMDANSATSEEMNEIIHARFIRAVSELELLGFIKPTKQKTDHVARLTWGGC

SEQ ID NO: 56614 - protein, 436 aa, Homo sapiens
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 56615 - protein, 436 aa, Homo sapiens; identical to SEQ ID NO: 56614

SEQ ID NO: 56616 - protein, 436 aa, Homo sapiens; identical to SEQ ID NO: 56614

SEQ ID NO: 56617 - protein, 145 aa, Homo sapiens
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKVFGSFAENLSFLLEALKK

SEQ ID NO: 56618 - protein, 127 aa, Homo sapiens
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDK

SEQ ID NO: 56619 - protein, 128 aa, Homo sapiens
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKV

SEQ ID NO: 56620 - protein, 436 aa, Homo sapiens; identical to SEQ ID NO: 56614

SEQ ID NO: 56621 - protein, 352 aa, Homo sapiens
MEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 56622 - protein, 362 aa, Homo sapiens
MLINHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 56623 - protein, 219 aa, Homo sapiens
MNSFGFPQYVKIFKEQLSLPAEFPDKVFAEKWNENVQYLSEDRSVQEVLQKHFNISKNLRSLHMLLMLALNRVTASHPFMTAVDLMEASQLCSMDSKANIVHGLSVLEICLIIAMKHLNDIYEEEPFNFQMVYNEFQKFVQRKAHSVYNFEKPVVMKAFEHLQQLELIKPMERTSGNSQREYQLMKLLLDNTQIMNALQKYPNCPTDVRQWATSSLSWL

SEQ ID NO: 56624 - protein, 435 aa, Homo sapiens
MPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 56625 - protein, 324 aa, Homo sapiens
MPHLENVVLCRESQVSILQSLFGERHHFSFPSIFIYGHTASGKTYVTQTLLKTLELPHVFVNCVECFTLRLLLEQILNKLNHLSSSEDGCSTEITCETFNDFVRLFKQVTTAENLKDQTVYIVLDKAEYLRDMEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGIRGSIETVTGDTSSANYQDTKVNTKEHSVRK

SEQ ID NO: 56626 - protein, 303 aa, Homo sapiens
MEANLLPGFLRLQELADRNVTVLFLSEIVWEKFRPNTGCFEPFVLYFPDYSIGNLQKILSHDHPPEYSADFYAAYINILLGVFYTVCRDLKELRHLAVLNFPKYCEPVVKGEASERDTRKLWRNIEPHLKKAMQTVYLREISSSQWEKLQKDDTDPGQLKGLSAHTHVELPYYSKFILIAAYLASYNPARTDKRFFLKHHGKIKKTNFLKKHEKTSNHLLGPKPFPLDRLLAILYSIVDSRVAPTANIFSQITSLVTLQLLTLVGHDDQLDGPKYKCTVSLDFIRAIARTVNFDIIKYLYDFL

SEQ ID NO: 56627 - protein, 252 aa, Homo sapiens
MGSELIGRLAPRLGLAEPDMLRKAEEYLRLSRVKCVGLSARTTETSSAVMCLDLAASWMKCPLDRAYLIKLSGLNKETYQSCLKSFECLLGLNSNIGIRDLAVQFSCIEAVNMASKILKSYESSLPQTQQVDLDLSRPLFTSAALLSACKILKLKVDKNKMVATSGVKKAIFDRLCKQLEKIGQQVDREPGDVATPPRKRKKIVVEAPAKEMEKVEEMPHKPQKDEDLTQDYEEWKRKILENAASAQKATAE

SEQ ID NO: 56628 - protein, 153 aa, Homo sapiens
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIILYFLASFYTKYDPTHFILNTASLLSVLIPKMPQLHGVRIFGINKY

SEQ ID NO: 56629 - protein, 153 aa, Homo sapiens; identical to SEQ ID NO: 56628

SEQ ID NO: 56630 - protein, 153 aa, Homo sapiens; identical to SEQ ID NO: 56628

SEQ ID NO: 56631 - protein, 109 aa, Homo sapiens
MNVGVAHSEVNPNTRVMNSRGMWLTYALGVGLLHIVLLSIPFFSVPVAWTLTNIIHNLGMYVFLHAVKGTPFETPDQGKARLLTHWEQLDYGVQFTSSRKFFTISPIIL

SEQ ID NO: 56632 - protein, 109 aa, Homo sapiens; identical to SEQ ID NO: 56631

SEQ ID NO: 56633 - protein, 153 aa, Homo sapiens
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 56634 - protein, 153 aa, Homo sapiens; identical to SEQ ID NO: 56633

SEQ ID NO: 56635 - protein, 153 aa, Homo sapiens
MNVGTAHSEVNPNTRVMNSRGIWLSYVLAIGLLHIVLLSIPFVSVPVVWTLTNLIHNMGMYIFLHTVKGTPFETPDQGKARLLTHWEQMDYGVQFTASRKFLTITPIVLYFLTSFYTKYDQIHFVLNTVSLMSVLIPKLPQLHGVRIFGINKY

SEQ ID NO: 56636 - protein, 153 aa, Homo sapiens; identical to SEQ ID NO: 56635

SEQ ID NO: 56637 - protein, 439 aa, Homo sapiens
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 56638 - protein, 301 aa, Homo sapiens
MNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 56639 - protein, 461 aa, Homo sapiens
MNNFGNEEFDCHFLDEGFTAKDILDQKINEVSSSDDKDAFYVADLGDILKKHLRWLKALPRVTPFYAVKCNDSKAIVKTLAATGTGFDCASKTEIQLVQSLGVPPERIIYANPCKQVSQIKYAANNGVQMMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPEVEEQDASTLPVSCAWESGMKRHRAACASASINV

SEQ ID NO: 56640 - protein, 461 aa, Homo sapiens; identical to SEQ ID NO: 56639

SEQ ID NO: 56641 - protein, 68 aa, Homo sapiens
MNNFGNEEFDCHFLDEGFTAKDILDQKINEVSSSDDKDAFYVADLGDILKKHLRWLKALPRVTPFYAV

SEQ ID NO: 56642 - protein, 308 aa, Homo sapiens
MMTFDSEVELMKVARAHPKAKLVLRIATDDSKAVCRLSVKFGATLRTSRLLLERAKELNIDVVGVSFHVGSGCTDPETFVQAISDARCVFDMGAEVGFSMYLLDIGGGFPGSEDVKLKFEEITGVINPALDKYFPSDSGVRIIAEPGRYYVASAFTLAVNIIAKKIVLKEQTGSDDEDESSEQTFMYYVNDGVYGSFNCILYDHAHVKPLLQKRPKPDEKYYSSSIWGPTCDGLDRIVERCDLPEMHVGDWMLFENMGAYTVAAASTFNGFQRPTIYYVMSGPAWQLMQQFQNPDFPPCLCLVPGRVG

SEQ ID NO: 56643 - protein, 227 aa, Homo sapiens
MVKSSLQRILNSHCFAREKEGDKPSATIHASRTMPLLSLHSRGGSSSESSRVSLHCCSNPGPGPRWCDAPHPPLKIPGGRGNSQRDHNLSANLFYSDDRLNVTEELTSNDKTRILNVQSRLTDAKRINWRTVLSGGSLYIEIPGGALPEGSKDSFAVLLEFAEEQLRADHVFICFHKNREDRAALLRTFSFLGFEIVRPGHPLVPKRPDACFMAYTFERESSGEEEE

SEQ ID NO: 56644 - protein, 276 aa, Homo sapiens
MWITSLITMKDEDIFDLAGDPQDSLIPGPSPTPKQNPVCNEAFFGHQTFSLRETGLKSVHCQGQEAENMEREKFQQKALKQTKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREDESGREETLNSEAPGSSNKSHEIHKEASEATTAHLEEFQRSQKTIILLGSSPLEQEIRSTSLHCMEDEMSHPWILLLKVTAVIRSRRYYREQRF

SEQ ID NO: 56645 - protein, 480 aa, Homo sapiens
MEREKFQQKALKQTKQKKSKSAEFLMVKEDREATEGTGNPAFNMSSPDLSACQTAEKKVIRHDMPDRTLAAHQQKFRLPASAEPKGNEYGRNYFDPLMDEEINPRQCATEVSREVCLMAKGEKAESGVDNTAGLSEKETQKNPRAPMDEADVKSAAHSSQGSIPKKIGPCSMDYDPNLLEEDDELHSQGDSLTDHSVKGKSTVWRIGEAEDYSQDISYLEELEEHRFSVCCSSVADSRYGDFFKHLHFVLVSASSELQLSQWQSQGFWYIILLMFFLWFLRLYLHYLGQWLFLQAISTPVTKFHFSLHIVELCYPTSSLHIGEELPVVVMGPLMLNAILLLLVLIRWGCQLLFASCPDVLSKLIITMGLWTILDPLAVFILDTLLGRLTDNEETPVADAAKLYWMFVRTVQPGILGVVITVLLYILLFVISSLILYLYCLRLHNDSWILDAFQRIHSEETKFFIPYDLEISNQELSYIVK

SEQ ID NO: 56646 - protein, 201 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRQDQCIYNTTYLNVQRENGTISRYVGGQEHFAHLLILRDTKTYMLAFDVNDEKNWGLSVYADKPETTKEQLGEFYEALDCLRIPKSDVVYTDWKKDKCEPLEKQHEKERKQEEGES

SEQ ID NO: 56647 - protein, 194 aa, Homo sapiens [sequence omitted]

SEQ ID NO: 56648 - protein, 194 aa, Homo sapiens [sequence omitted]

SEQ ID NO: 56649 - protein, 201 aa, Homo sapiens
MALSWVLTVLSLLPLLEAQIPLCANLVPVPITNATLDRITGKWFYIASAFRNEEYNKSVQEIQATFFYFTPNKTEDTIFLREYQTRQNQCFYNSSYLNVQRENGTVSRYEGGREHVAHLLFLRDTKTLMFGSYLDDEKNWGLSFYADKPETTKEQLGEFYEALDCLCIPRSDVMYTDWKKDKCEPLEKQHEKERKQEEGES

SEQ ID NO: 56650 - protein, 354 aa, Homo sapiens
MMSYLKQPPYGMNGLGLAGPAMDLLHPSVGYPATPRKQRRERTTFTRSQLDVLEALFAKTRYPDIFMREEVALKINLPESRVQVWFKNRRAKCRQQQQSGSGTKSRPAKKKSSPVRESSGSESSGQFTPPAVSSSASSSSSASSSSANPAAAAAAGLGGNPVAAASSLSTPAASSIWSPASISPGSAPASVSVPEPLAAPSNTSCMQRSVAAGAATAAASYPMSYGQGGSYGQGYPTPSSSYFGGVDCSSYLAPMHSHHHPHQLSPMAPSSMAGHHHHHPHAHHPLSQSSGHHHHHHHHHHQGYGGSGLAFNSADCLDYKEPGAAAASSAWKLNFNSPDCLDYKDQASWRFQVL

SEQ ID NO: 56651 - protein, 354 aa, Homo sapiens; identical to SEQ ID NO: 56650

SEQ ID NO: 56652 - protein, 297 aa, Homo sapiens
MMSYLKQPPYAVNGLSLTTSGMDLLHPSVGYPGPWASCPAATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSHLNQSPASLSTQGYGASSLGFNSTTDCLDYKDQTASWKLNFNADCLDYKDQTSSWKFQVL

SEQ ID NO: 56653 - protein, 289 aa, Homo sapiens
MMSYLKQPPYAVNGLSLTTSGMDLLHPSVGYPATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSHLNQSPASLSTQGYGASSLGFNSTTDCLDYKDQTASWKLNFNADCLDYKDQTSSWKFQVL

SEQ ID NO: 56654 - protein, 239 aa, Homo sapiens
MMSYLKQPPYAVNGLSLTTSGMDLLHPSVGYPGPWASCPAATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDPLSTSSSCMQRSYPMTYTQASGYSQGYAGSTSYFGGMDCGSYLTPMHHQLPGPGATLSPMGTNAVTSHL

SEQ ID NO: 56655 - protein, 289 aa, Homo sapiens; identical to SEQ ID NO: 56653

SEQ ID NO: 56656 - protein, 163 aa, Homo sapiens
MMSYLKQPPYAVNGLSLTTSGMDLLHPSVGYPATPRKQRRERTTFTRAQLDVLEALFAKTRYPDIFMREEVALKINLPESRVQVWFKNRRAKCRQQQQQQQNGGQNKVRPAKKKTSPAREVSSESGTSGQFTPPSSTSVPTIASSSAPVSIWSPASISPLSDP

SEQ ID NO: 56657 - protein, 325 aa, Homo sapiens
MLSHADLLDARLGMKDAAELLGHREAVKCRLGVGGSDPGGHPGDLAPNSDPVEGATLLPGEDITTVGSTPASLAVSAKDPDKQPGPQGGPNPSQAGQQQGQQKQKRHRTRFTPAQLNELERSFAKTHYPDIFMREELALRIGLTESRVQVWFQNRRAKWKKRKKTTNVFRAPGTLLPTPGLPQFPSAAAAAAAAMGDSLCSFHANDTRWAAAAMPGVSQLPLPPALGRQQAMAQSLSQCSLAAGPPPNSMGLSNSLAGSNGAGLQSHLYQPAFPGMVPASLPGPSNVSGSPQLCSSPDSSDVWRGTSIASLRRKALEHTVSMSFT

SEQ ID NO: 56658 - protein, 335 aa, Homo sapiens
MPAVLGFEGSANKIGVGVVRDGKVLANPRRTYVTPPGTGFLPGDTARHHRAVILDLLQEALTESGLTSQDIDCIAYTKGPGMGAPLVSVAVVARTVAQLWNKPLVGVNHCIGHIEMGRLITGATSPTVLYVSGGNTQVIAYSEHRYRIFGETIDIAVGNCLDRFARVLKISNDPSPGYNIEQMAKRGKKLVELPYTVKGMDVSFSGILSFIEDVAHRMLATGECTPEDLCFSLQETVFAMLVEITERAMAHCGSQEALIVGGVGCNVRLQEMMATMCQERGARLFATDERFCIDNGAMIAQAGWEMFRAGHRTPLSDSGVTQRYRTDEVEVTWRD

SEQ ID NO: 56659 - protein, 286 aa, Homo sapiens
MALVLILQLLTLWPLCHTDITPSVAIIVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 56660 - protein, 282 aa, Homo sapiens
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 56661 - protein, 252 aa, Homo sapiens
MALVLILQLLTLFPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 56662 - protein, 267 aa, Homo sapiens
MALVLILQLLTLWPLCHTDITPSVAIIVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 56663 - protein, 263 aa, Homo sapiens
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGIYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEDSGSSDYTRGNLVRLGLAGLVLISLGALVTFDWRSQNRAPAGIRP

SEQ ID NO: 56664 - protein, 214 aa, Homo sapiens
MSKPPPKPVKPGQVKVFRALYTFEPRTPDELYFEEGDIIYITDMSDTNWWKGTSKGRTGLIPSNYVAEQAESIDNPLHEAAKRGNLSWLRECLDNRVGVNGLDKAGSTALYWACHGGHKDIVEMLFTQPNIELNQQNKLGDTALHAAAWKGYADIVQLLLAKGARTDLRNIEKKLAFDMATNAACASLLKKKQGTDAVRTLSNAEDYLDDEDSD

SEQ ID NO: 56665 - protein, 298 aa, Homo sapiens
MKTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFKKLNNLTFLYLDHNALESVPLNLPESLRVIHLQFNNIASITDDTFCKANDTSYIRDRIEEIRLEGNPIVLGKHPNSFICLKRLPIGSYF

SEQ ID NO: 56666 - protein, 298 aa, Homo sapiens; identical to SEQ ID NO: 56665

SEQ ID NO: 56667 - protein, 268 aa, Homo sapiens
MLAKISTTWKLFLKLLGPEILLSSLKSRHSFSHSPSHLGLMHRHEHLLRKTTKNFKTATTTLQSTLLLLLLVPLIKPAPPTQQDSRIIYDYGTDNFEESIFSQDYEDKYLDGKNIKEKETVIIPNEKSLQLQKDEAITPLPPKKENDEMPTCLLCVCLSGSVYCEEVDIDAVPPLPKESAYLYARFNKIKKLTAKDFADIPNLRRLDFTGNLIEDIEDGTFSKLSLLEELSLAENQLLKLPVLPPKLTLFNAKYNKIKSRGIKANAFK

SEQ ID NO: 56668 - protein, 613 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQAVDSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 56669 - protein, 652 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 56670 - protein, 560 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 56671 - protein, 580 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKFLCDEGAGISGDYIDRVDEPLSCSYVLTIRTPRLCPHPLLRPPPSAAPQAILCHPSLQPEEYMAYVQRQAVDSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 56672 - protein, 667 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTEEDPEHRVRVRVTKLRLGGPNQDLTVLEMKRENPQLKQIEGLVKELLEREGLTAAGKIEIKIVRPWAEGTEEGARWLTDEDTRNLKEIFFNILVPGAEEAQKERQRQKELESNYRRVWGSPGGEGTGDLDEFDF

SEQ ID NO: 56673 - protein, 597 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 56674 - protein, 612 aa, Homo sapiens
MAAETLLSSLLGLLLLGLLLPASLTGGVGSLNLEELSEMRYGIEILPLPVMGGQSQSSDVVIVSSKYKQRYECRLPAGAIHFQREREEETPAYQGPGIPELLSPMRDAPCLLKTKDWWTYEFCYGRHIQQYHMEDSEIKGEVLYLGYYQSAFDWDDETAKASKQHRLKRYHSQTYGNGSKCDLNGRPREAEVRFLCDEGAGISGDYIDRVDEPLSCSYVLTIRTPRLCPHPLLRPPPSAAPQAILCHPSLQPEEYMAYVQRQADSKQYGDKIIEELQDLGPQVWSETKSGVAPQKMAGASPTKDDSKDSDFWKMLNEPEDQAPGGEEVPAEEQDPSPEAADSASGAPNDFQNNVQVKVIRSPADLIRFIEELKGGTKKGKPNIGQEQPVDDAAEVPQREPEKERGDPERQREMEEEEDEDEDEDEDEDERQLLGEFEKELEGILLPSDRDRLRSEVKAGMERELENIIQETEKELDPDGLKKESERDRAMLALTSTLNKLIKRLEEKQSPELVKKHKKKRVVPKKPPPSPQPTGKIEIKIVRPWAEGTEEGARWLTDEDTRNLKEIFFNILVPGAEEAQKERQRQKELESNYRRVWGSPGGEGTGDLDEFDF

SEQ ID NO: 56675 - protein, 1153 aa, Homo sapiens
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRQAHELWALEPFPKMLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 56676 - protein, 548 aa, Homo sapiens
PRAVWVEARGGAQHPTMRRTAPLHRGTWSKMSIILRARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 56677 - protein, 1060 aa, Homo sapiens
MGNSITYRDQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 56678 - protein, 815 aa, Homo sapiens
MFRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 56679 - protein, 1139 aa, Homo sapiens
MSQEPTTYSLFLFLFLSHGVSSYTVPNSRQDLHPLLQNMAEEIIDGSYLNALLDLIQFQSSHVWTDDLSHRVLAYLNSRNVAFTIPSLQAAVENHLEQRLHQPQKLLEDLRKTDAQQFRTAMKCLLEDKKDGLDLKDIIIDLGEIRERALQSPGVNRSLFLITLERCFQMLNSLECVEILGKVLRGSSGSFLQPDITERLPRDLREDAFKNLSAVFKDLYDKTSAHSQRALYSWMTGILQTSSNATDDSASWVSAEHLWVLGRYMVHLSFEEITKISPIEIGLFISYDNATKQLDMVYDITPELAQAFLERISSSNFNMRNTSTIHRLGLLVCFYNDLELLDATVAQVLLYQMIKCSHLRGFQAGVQKLKAELLDIAMENQTLNETLGSLSDAVVGLTYSQLESLSPEAVHGAISTLNQVSGWAKSQVIILSAKYLAHEKVLSFYNVSQMGALLAGVSTQAFCSMKRKDISQVLRSAVSQYVSDLSPAQQQGILSKMVQAEDTAPGIVEIQGAFFKEVSLFDLRRQPGFNSTVLKDKELGRSQALFLYELLLKTTRRPEELLSAGQLVKGVTCSHIDAMSTDFFLAHFQDFQNNFALLSPYQVNCLAWKYWEVSRLSMPPFLLAALPARYLASVPASQCVPFLISLGKSWLDSLVLDSHKKTSVLRKVQQCLDDSIADEYTVDIMGNLLCHLPAAIIDRGISPRAWATALHGLRDCPDLNPEQKAAVRLKLLGQYGLPQHWTAETTKDLGPFLVLFSGDELSSIATKFPEILLQAASKMARTLPTKEFLWAVFQSVRNSSDKIPSYDPMPGCHGVVAPSSDDIFKLAEANACWALEDLRCMEEDTFIRTVELLGAVQGFSRPQLMTLKEKAIQVWDMPSYWREHHIVSLGRIALALNESELEQLDLSSIDTVASLSWQTEWTPGQAESILQGYLDDSGYSIQDLKSFHLVGLGATLCAINITEIPLIKISEFRVVVARIGTLLCSTHVLAEFKRKAEVVFGDPTEWTSSVLQELGTIAAGLTKAELRMLDKDLMPYFQPSAIKCLPDEIFKELSAEQIASLGPENAAAVTHAQRRRLSPLQLQSLQQALDGAKTHSWQDAPASAGPTRTSSSRSPAGALQSWGLWLGCPLLVLMAKLLW

SEQ ID NO: 56680 - protein, 477 aa, Homo sapiens
MIAFLLTSVLMIPHAGGHPLDTPHLPQELPPGLPNNINITFFSGMFKNVESVAEIFDCLGPHFTWLQAVFTNFPVLIQFVNGMKCVAGLCPRDFEDYGCTCRFEMEGLPVDESDSCCFQHRRCYEEAAEMDCLQDPAKLSTEVNCVSKKIICESKDNCEHLLCTCDKAAIECLARSSLNSSLNLLDTSFCLAQTPETTIKEDLTTLLPRVVPVEPTDTSLTALSGEEAGHDQEGVGAARATSPPGSAEIVATRVTAKIVTLVPAGIKSLGLAVSSVENDPEETTEKACDRFTFLHLGSGDNMQVMPQLGEMLFCLTSRCPEEFESYGCYCGQEGRGEPRDDLDRCCLSHHCCLEQVRRLGCLLERLPWSPVVCVDHTPKCGGQSLCEKLLCACDQTAAECMTSASFNQSLKSPSRLGCPGQPAACEDSLHPVPAAPTLGSSSEEDSEEDPPQEDLGRAKRFLRKSLGPLGIGPLHGR

SEQ ID NO: 56681 - protein, 493 aa, Homo sapiens
MIAFLLTSVLMIPHAGGHPLDTPHLPQELPPGLPNNINITFFSGMFKNVESVAEIFDCLGPHFTWLQAVFTNFPVLIQFVNGMKCVAGLCPRDFEDYGCTCRFEMEGLPVDESDSCCFQHRRCYEEAAEMDCLQDPAKLSTEVNCVSKKIICESKDNCEHLLCTCDKAAIECLARSSLNSSLNLLDTSFCLAQTPETTIKEDLTTLLPRVVPVEPTDTSLTALSGEVAAETEADRLITLSKKKAGHDQEGVGAARATSPPGSAEIVATRVTAKIVTLVPAGIKSLGLAVSSVENDPEETTEKACDRFTFLHLGSGDNMQVMPQLGEMLFCLTSRCPEEFESYGCYCGQEGRGEPRDDLDRCCLSHHCCLEQVRRLGCLLERLPWSPVVCVDHTPKCGGQSLCEKLLCACDQTAAECMTSASFNQSLKSPSRLGCPGQPAACEDSLHPVPAAPTLGSSSEEDSEEDPPQEDLGRAKRFLRKSLGPLGIGPLHGR

SEQ ID NO: 56682 - protein, 1997 aa, Homo sapiens
MALLIHLKTVSELRGRGDRIAKVTFRGQSFYSRVLENCEDVADFDETFRWPVASSIDRNEMLEIQVFNYSKVFSNKLIGTFRMVLQKVVEESHVEVTDTLIDDNNAIIKTSLCVEVRYQATDGTVGSWDDGDFLGDESLQEEEKDSQETDGLLPGSRPSSRPPGEKSFRRAGRSVFSAMKLGKNRSHKEEPQRPDEPAVLEMEDLDHLAIRLGDGLDPDSVSLASVTALTTNVSNKRSKPDIKMEPSAGRPMDYQVSITVIEARQLVGLNMDPVVCVEVGDDKKYTSMKESTNCPYYNEYFVFDFHVSPDVMFDKIIKISVIHSKNLLRSGTLVGSFKMDVGTVYSQPEHQFHHKWAILSDPDDISSGLKGYVKCDVAVVGKGDNIKTPHKANETDEDDIEGNLLLPEGVPPERQWARFYVKIYRAEGLPRMNTSLMANVKKAFIGENKDLVDPYVQVFFAGQKGKTSVQKSSYEPLWNEQVVFTDLFPPLCKRMKVQIRDSDKVNDVAIGTHFIDLRKISNDGDKGFLPTLGPAWVNMYGSTRNYTLLDEHQDLNEGLGEGVSFRARLLLGLAVEIVDTSNPELTSSTEVQVEQATPISESCAGKMEEFFLFGAFLEASMIDRRNGDKPITFEVTIGNYGNEVDGLSRPQRPRPRKEPGDEEEVDLIQNASDDEAGDAGDLASVSSTPPMRPQVTDRNYFHLPYLERKPCIYIKSWWPDQRRRLYNANIMDHIADKLEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 56683 - protein, 1230 aa, Homo sapiens
MIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 56684 - protein, 1230 aa, Homo sapiens
MIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTAFVWFLNPLKSIKYLICTRYKWLIIKIVLALLGLLMLGLFLYSLPGYMVKKLLGA

SEQ ID NO: 56685 - protein, 77 aa, Homo sapiens
EAEKNPVGLARNEPDPLEKPNRPDTAFVWFLNPLKSIKYLICTRYKWLIIKIVLALGCSCWGPLQPPWLHGQKAPWG

SEQ ID NO: 56686 - protein, 113 aa, Homo sapiens
DFLGDESLQEEEKDSQETDGLLPGSRPSSRPPGEKSFRSKGREKTKGGRDDEHKAGRSVFSAMKLGKNRSHKEEPQRPDEPAVLEMEDLDHLAIRLGDGLDPDSVSLASVTAL

SEQ ID NO: 56687 - protein, 1307 aa, Homo sapiens
MMTDTQDGPSESSQIMRSLTPLINREEAFGEAGEAGLWPSITHTPDSQEEGLNDIQEMIKTEKSYPERRLRGVLEELSCGCCRFLSLADKDQGHSSRTRLDRERLKSCMRELENMGQQARMLRAQVKRHTVRDKLRLCQNFLQKLRFLADEPQHSIPDIFIWMMSNNKRVAYARVPSKDLLFSIVEEETGKDCAKVKTLFLKLPGKRGFGSAGWTVQAKVELYLWLGLSKQRKEFLCGLPCGFQEVKAAQGLGLHAFPPVSLVYTKKQAFQLRAHMYQARSLFAADSSGLSDPFARVFFINQSQCTEVLNETLCPTWDQMLVFDNLELYGEAHELRDDPPIIVIEIYDQDSMGKADFMGRTFAKPLVKMADEAYCPPRFPPQLEYYQIYRGNATAGDLLAAFELLQIGPAGKADLPPINGPVDVDRGPIMPVPMGIRPVLSKYRVEVLFWGLRDLKRVNLAQVDRPRVDIECAGKGVQSSLIHNYKKNPNFNTLVKWFEVDLPENELLHPPLNIRVVDCRAFGRYTLVGSHAVSSLRRFIYRPPDRSAPSWNTTVRLLRRCRVLCNGGSSSHSTGEVVVTMEPEVPIKKLETMVKLDATSEAVVKVDVAEEEKEKKKKKKGTAEEPEEEEPDESMLDWWSKYFASIDTMKEQLRQQEPSGIDLEEKEEVDNTEGLKGSMKGKEKARAAKEEKKKKTQSSGSGQGSEAPEKKKPKIDELKVYPKELESEFDNFEDWLHTFNLLRGKTGDDEDGSTEEERIVGRFKGSLCVYKVPLPEDVSREAGYDSTYGMFQGIPSNDPINVLVRVYVVRATDLHPADINGKADPYIAIRLGKTDIRDKENYISKQLNPVFGKSFDIEASFPMESMLTVAVYDWDLVGTDDLIGETKIDLENRFYSKHRATCGIAQTYSTHGYNIWRDPMKPSQILTRLCKDGKVDGPHFGPPGRVKVANRVFTGPSEIEDENGQRKPTDEHVALLALRHWEDIPRAGCRLVPEHVETRPLLNPDKPGIEQGRLELWVDMFPMDMPAPGTPLDISPRKPKKYELRVIIWNTDEVVLEDDDFFTGEKSSDIFVRGWLKGQQEDKQDTDVHYHSLTGEGNFNWRYLFPFDYLAAEEKIVISKKESMFSWDETEYKIPARLTLQIWDADHFSADDFLGAIELDLNRFPRGAKTAKQCTMEMATGEVDVPLVSIFKQKRVKGWWPLLARNENDEFELTGKVEAELHLLTAEEAEKNPVGLARNEPDPLEKPNRPDTSFIWFLNPLKSARYFLWHTYRWLLLKLLLLLLLLLLLALFLYSVPGYLVKKILGA

SEQ ID NO: 56688 - protein, 1508 aa, Homo sapiens
MFPARGVPLHLEGEGVFPWGPGDVSLPYLSTSDVSFSVIVENVNCYSSGMICRKFISINVGNSLIVFDDDSGNPSPESFLDDKQEVHTWRVGFFTLVHFPQEHITLLWDQRTTVHVQAGPQWQGQLAGLCGNFDLKTINEMRTPENLELTNPQEFGSSWAAVECPDTLDPRDMCVLNPLREPFAKKECSILLSEVFEICHPVVDVTWFYSNCLTDTCGCSQGGDCECFCASVSAYAHQCCQHGVAVDWRTPRLCLLGKGPYQLSSLAAGGALVGMKAVGDDIVLVRTEDVAPADIVSFLLTAALYKAKAHDPDVVSLEAADRPNFFLHVTANGSLELAKWQGRDTFQQHASFLLHRGTRQAGLVALESLAKPSSFLYVSGAVLALRLYEHTEVFRRGTLFRLLDAKPSGAAYPICEWRYDACASPCFQTCRDPRAASCRDVPRVEGCVPVCPTPQVLDEVTQRCVYLEDCVEPAVWVPTEALGNETLPPSQGLPTPSDEEPQLSQESPRTPTHRPALTPAAPLTTALNPPVTATEEPVVSPGPTQTTLQQPLELTASQLPAGPTESPASKGVTASLLAIPHTPESSSLPVALQTPTPGMVSGAMETTRVTVIFAGSPNITVSSRSPPAPRFPLMTKAVTVRGHGSLPVRTTPPQPSLTASPSSRPVASPGAISRSPTSSGSHKAVLTPAVTKVISRTGVPQPTQAQSASSPSTPLTVAGTAAEQVPVSPLATRSLEIVLSTEKGEAGHSQPMGSPASPQPHPLPSAPPRPAQHTTMATRSPALPPETPAAASLSTATDGLAATPFMSLESTRPSQLLSGLPPDTSLPLAKVGTSAPVATPGPKASVITTPLQPQATTLPAQTLSPVLPFTPAAMTQAHPPTHIAPPAAGTAPGLLLGATLPTSGVLPVAEGTASMVSVVPRKSTTGKVAILSKQVSLPTSMYGSAEGGPTELTPATSHPLTPLVAEPEGAQAGTALPVPTSYALSRVSARTAPQDSMLVLLPQLAEAHGTSAGPHLAAEPVDEATTEPSGRSAPALSIVEGLAEALATTTEANTSTTCVPIAEQDCVRHICLEGQLIRVNQSQHCPQGAAPPRCGILGLAVRVGGDRCCPLWECACRCSIFPDLSFVTFDGSHVALFKEAIYILSQSPDEMLTVHVLDCKSANLGHLNWPPFCLVMLNMTHLAHQVTIDRFNRKVTVDLQPVWPPVSRYGFRIEDTGHMYMILTPSDIQIQWLHSSGLMIVEASKTSKAQGHGLCGICDGDAANDLTLKDGSVVGGAEDPAPFLDSWQVPSSLTSVGQTRFRPDSCATTDCSPCLRMVSNRTFSACHRFVPPESFCELWIRDTKYVQQPCVALTVYVAMCHKFHVCIEWRRSDYCPFLCSSDSTYQACVTACEPPKTCQDGILGPLDPEHCQVLGEGCVCSEGTILHRRHSALCIPEAKCACGDCPDSIPECQEGEALTVHRNTTELCCPLYQCVCENFRCPQVQCGLGTALVEVWSPDRCCPYKSCG

SEQ ID NO: 56689 - protein, 2925 aa, Homo sapiens
MGVLASALCWLLCVWLPWGEQAAESLRVQRLGERVVDSGRSGARGMRNVKGMRNGPAQTRVSSSSSHQEATLAMGDKATVVGGQQAEAPDSVAMSSWERRLHRAKCAPSYLFSCFNGGECVHPAFCDCRRFNATGPRCQMVYNAGPERDSICRAWGQHHVETFDGLYYYLSGKGSYTLVGRHEPEGQSFSIQVHNDPQCGSSPYTCSRAVSLFFVGEQEIHLAKEVTHGGMRVQLPHVMGSARLQQLAGYVIVRHQSAFTLAWDGASAVYIKMSPELLGWTHGLCGNNNADPKDDLVTSSGKLTDDVVEFVHSWQEQAPNQPPGPTTSSLPRPPCLQQNPGTMQGVYEQCEALLRPPFDACHAYVSPLPFTASCTSDLCQSMGDVATWCRALAEYARACAQAGRPLQGWRTQLRQCTVHCKEKAFTYNECIACCPASCHPRASCVDSEIACVDGCYCPNGLIFEDGGCVAPAECPCEFHGTLYPPGSVVKEDCNTCTCTSGKWECSTAVCPAECSVTGDIHFTTFDGRRYTFPATCQYILAKSRSSGTFTVTLQNAPCGLNQDGACVQSVSVILHQDPRRQVTLTQAGDVLLFDQYKIIPPYTDDAFEIRRLSSVFLRVRTNVGVRVLYDREGLRLYLQVDQRWVEDTVGLCGTFNGNTQDDFLSPVGVPESTPQLFGNSWKTLSACSPLVSGSPLDPCDVHLQAASYSVQACSVLTGEMFAPCSAFLSPVPYFEQCRRDACRCGQPCLCATLAHYAHLCRRHGLPVDFRARLPACALSCEASKEYSPCVAPCGRTCQDLASPEACGVDGGDDLSRDECVEGCACPPDTYLDTQADLCVPRNQCSCHFQGVDYPPGDSDIPSLGHCHCKDGVMSCDSRAPAAACPAGQVFVNCSDLHTDLELSRERTCEQQLLNLSVSARGPCLSGCACPQGLLRHGDACFLPEECPCTWKGKEYFPGDQVMSPCHTCVCQRGSFQCTLHPCASTCTAYGDRHYRTFDGLPFDFVGACKVHLVKSTSDVSFSVIVENVNCYSSGMICRKFISINVGNSLIVFDDDSGNPSPESFLDDKQEVHTWRVGFFTLVHFPQEHITLLWDQRTTVHVQAGPQWQGQLAGLCGNFDLKTINEMRTPENLELTNPQEFGSSWAAVECPDTLDPRDMCVLNPLREPFAKKECSILLSEVFEICHPVVDVTWFYSNCLTDTCGCSQGGDCECFCASVSAYAHQCCQHGVAVDWRTPRLCPYDCDFFNKVLGKGPYQLSSLAAGGALVGMKAVGDDIVLVRTEDVAPADIVSFLLTAALYKAKAHDPDVVSLEAADRPNFFLHVTANGSLELAKWQGRDTFQQHASFLLHRGTRQAGLVALESLAKPSSFLYVSGAVLALRLYEHTEVFRRGTLFRLLDAKPSGAAYPICEWRYDACASPCFQTCRDPRAASCRDVPRVEGCVPVCPTPQVLDEVTQRCVYLEDCVEPAVWVPTEALGNETLPPSQGLPTPSDEEPQLSQESPRTPTHRPALTPAAPLTTALNPPVTATEEPVVSPGPTQTTLQQPLELTASQLPAGPTESPASKGVTASLLAIPHTPESSSLPVALQTPTPGMVSGAMETTRVTVIFAGSPNITVSSRSPPAPRFPLMTKAVTVRGHGSLPVRTTPPQPSLTASPSSRPVASPGAISRSPTSSGSHKAVLTPAVTKVISRTGVPQPTQAQSASSPSTPLTVAGTAAEQVPVSPLATRSLEIVLSTEKGEAGHSQPMGSPASPQPHPLPSAPPRPAQHTTMATRSPALPPETPAAASLSTATDGLAATPFMSLESTRPSQLLSGLPPDTSLPLAKVGTSAPVATPGPKASVITTPLQPQATTLPAQTLSPVLPFTPAAMTQAHPPTHIAPPAAGTAPGLLLGATLPTSGVLPVAEGTASMVSVVPRKSTTGKVAILSKQVSLPTSMYGSAEGGPTELTPATSHPLTPLVAEPEGAQAGTALPVPTSYALSRVSARTAPQDSMLVLLPQLAEAHGTSAGPHLAAEPVDEATTEPSGRSAPALSIVEGLAEALATTTEANTSTTCVPIAEQDCVRHICLEGQLIRVNQSQHCPQGAAPPRCGILGLAVRVGGDRCCPLWECACRCSIFPDLSFVTFDGSHVALFKEAIYILSQSPDEMLTVHVLDCKSANLGHLNWPPFCLVMLNMTHLAHQVTIDRFNRKVTVDLQPVWPPVSRYGFRIEDTGHMYMILTPSDIQIQWLHSSGLMIVEASKTSKAQGHGLCGICDGDAANDLTLKDGSVVGGAEDPAPFLDSWQVPSSLTSVGQTRFRPDSCATTDCSPCLRMVSNRTFSACHRFVPPESFCELWIRDTKYVQQPCVALTVYVAMCHKFHVCIEWRRSDYCPFLCSSDSTYQACVTACEPPKTCQDGILGPLDPEHCQVLGEGCVCSEGTILHRRHSALCIPEAKCACTDSMGVPRALGETWNSSLSGCCQHQCQAPDTIVPVDLGCPSPRPESCLRFGEVALLLPTKDPCCLGTVCVCNQTLCEGLAPTCRPGHRLLTHFQEDSCCPSYSCECDPDLCEAELVPSCRQDQILITGRLGDSCCTSYFCACGDCPDSIPECQEGEALTVHRNTTELCCPLYQCVCENFRCPQVQCGLGTALVEVWSPDRCCPYKSCECDCDTIPVPRCHLWEKSQLDEEFMHSVENVCGCAKYECVKAPVCLSRELGVMQPGQTVVELSADGVCHTSRCTTVLDPLTNFYQINTTSVLCDIHCEANQEYEHPRDLAACCGSCRNVSCLFTFPNGTTSLFLPGASWIADCARHHCSSTPLGAVLVRSPISCPPLNETECAKVGGSVVPSLEGCCRTCKEDGRSCKKVTIRMTIRKNECRSSTPVNLVSCDGRCPSASIYNYNINTYARFCKCCREVGLQRRSVQLFCATNATWVPYTVQEPTDCACQWS

SEQ ID NO: 56690 - protein, 128 aa, Homo sapiens
MARILLLFLPGLVAVCAVHGIFMDRLASKKLCADDECVYTISLASAQEDYNAPDCRFINVKKGQQIYVYSKLVKENGAGEFWAGSVYGDGQDEMGVVGYFPRNLVKEQRVYQEATKEVPTTDIDFFCE

SEQ ID NO: 56691 - protein, 481 aa, Homo sapiens
MQLYSSVCTHYPAGAPGPTAAAPAPPAAATPFKVSLQPPGAAGAAPEPETGECQPAAAAEHREAAAVPAAKMPAFSSCFEVVSGAAAPASAAAGPPGASCKPPLPPHYTSTAQITVRALGADRLLLHGPDPVPGAAGSAAAPRGRCLLLAPAPAAPVPPRRGSSAWLLEELLRPDCPEPAGLDATREGPDRNFRLSEHRQALAAAKHRGPAATPGSPDPGPGPWGEEHLAERGPRGWERGGDRCDAPGGDAARRPDPEAEAPPAGSIEAAPSSAAEPVIVSRSDPRDEKLALYLAEVEKQDKYLRQRNKYRFHIIPDGNCLYRAVSKTVYGDQSLHRELREQTVHYIADHLDHFSPLIEGDVGEFIIAAAQDGAWAGYPELLAMGQMLNVNIHLTTGGRLESPTVSTMIHYLGPEDSLRPSIWLSWLSNGHYDAVFDHSYPNPEYDNWCKQTQVQRKRDEELAKSMAISLSKMYIEQNACS

SEQ ID NO: 56692 - protein, 398 aa, Homo sapiens
MSRKQAAKSRPGSGSRKAEAERKRDERAARRALAKERRNRPESGGGGGCEEEFVSFANQLQALGLKLREVPGDGNCLFRALGDQLEGHSRNHLKHRQETVDYMIKQREDFEPFVEDDIPFEKHVASLAKPGTFAGNDAIVAFARNHQLNVVIHQLNAPLWQIRGTEKSSVRELHIAYRYGEHYDSVRRINDNSEAPAHLQTDFQMLHQDESNKREKIKTKGMDSEDDLRDEVEDAVQKVCNATGCSDFNLIVQNLEAENYNIESAIIAVLRMNQGKRNNAEENLEPSGRVLKQCGPLWEEGGSGARIFGNQGLNEGRTENNKAQASPSEENKANKNQLAKVTNKQRREQQWMEKKKRQEERHRHKALESRGSHRDNNRSEAEANTQVTLVKTFAALNI

SEQ ID NO: 56693 - protein, 145 aa, Homo sapiens
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCK

SEQ ID NO: 56694 - protein, 1114 aa, Homo sapiens
MEAAVGVPDGGDQGGAGPREDATPMDAYLRKLGLYRKLVAKDGSCLFRAVAEQVLHSQSRHVEVRMACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNEQLKNNGNSTSLPLSRKVLKSLNPAVYRNVEYEIWLKSKQAQQKRDYSIAAGLQYEVGDKCQVRLDHNGKFLNADVQGIHSENGPVLVEELGKKHTSKNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMDTEERKDKDSIHGHSQLDKRPEPSTLENITDDKYATVSSPSKSKKLECPSPAEQKPAEHVSLSNPAPLLVSPEVHLTPAVPSLPATVPAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 56695 - protein, 1049 aa, Homo sapiens
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDSEDDSCKSKTAAAAADVNGFKPLSGNEQLKNNGNSTSLPLSRKVLKSLNPAVYRNVEYEIWLKSKQAQQKRDYSIAAGLQYEVGDKCQVRLDHNGKFLNADVQGIHSENGPVLVEELGKKHTSKNLKAPPPESWNTVSGKKMKKPSTSGQNFHSDVDYRGPKNPSKPIKAPSALPPRLQHPSGVRQHAFSSHSSGSQSQKFSSEHKNLSRTPSQIIRKPDRERVEDFDHTSRESNYFGLSPEERREKQAIEESRLLYEIQNRDEQAFPALSSSSVNQSASQSSNPCVQRKSSHVGDRKGSRRRMDTEERKDKDSIHGHSQLDKRPEPSTLENITDDKYATVSSPSKSKKLECPSPAEQKPAEHVSLSNPAPLLVSPEVHLTPAVPSLPATVPAWPSEPTTFGPTGVPAPIPVLSVTQTLTTGPDSAVSQAHLTPSPVPVSIQAVNQPLMPLPQTLSLYQDPLYPGFPCNEKGDRAIVPPYSLCQTGEDLPKDKNILRFFFNLGVKAYSCPMWAPHSYLYPLHQAYLAACRMYPKVPVPVYPHNPWFQEAPAAQNESDCTCTDAHFPMQTEASVNGQMPQPEIGPPTFSSPLVIPPSQVSESHGQLSYQADLESETPGQLLHADYEESLSGKNMFPQPSFGPNPFLGPVPIAPPFFPHVWYGYPFQGFIENPVMRQNIVLPSDEKGELDLSLENLDLSKDCGSVSTVDEFPEARGEHVHSLPEASVSSKPDEGRTEQSSQTRKADTALASIPPVAEGKAHPPTQILNRERETVPVELEPKRTIQSLKEKTEKVKDPKTAADVVSPGANSVDSRVQRPKEESSEDENEVSNILRSGRSKQFYNQTYGSRKYKSDWGYSGRGGYQHVRSEESWKGQPSRSRDEGYQYHRNVRGRPFRGDRRRSGMGDGHRGQHT

SEQ ID NO: 56696 - protein, 139 aa, Homo sapiens
MACIHYLRENREKFEAFIEGSFEEYLKRLENPQEWVGQVEISALSLMYRKDFIIYREPNVSPSQVTENNFPEKVLLCFSNGNHYDIVYPIKYKESSAMCQSLLYELLYEKVFKTDVSKIVMELDTLEVADEDNSEISDS

SEQ ID NO: 56697 - protein, 145 aa, Homo sapiens; identical to SEQ ID NO: 56693

SEQ ID NO: 56698 - protein, 571 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTGTSAVEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 56699 - protein, 566 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 56700 - protein, 566 aa, Homo sapiens; identical to SEQ ID NO: 56699

SEQ ID NO: 56701 - protein, 349 aa, Homo sapiens
MKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 56702 - protein, 542 aa, Homo sapiens
MTILPKKKPPPPDADPGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 56703 - protein, 444 aa, Homo sapiens
GVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNADYFSNYVTEDFTTYINRKRKNNCHGNHIEMQAMAEMYNRPVEVYQYSTGTSAVEPINTFHGIHQNEDEPIRVSYHRNIHYNSVVNPNKATIGVGLGLPSFKPGFAEQSLMKNAIKTSEESWIEQQMLEDKKRATDWEATNEAIEEQVARESYLQWLRDQEKQARQVRGPSQPRKASATCSSATAAASSGLEEWTSRSPRQRSSASSPEHPELHAELGMKPPSPGTVLALAKPPSPCAPGTSSQFSAGADRATSPLVSLYPALECRALIQQMSPSAFGLNDWDDDEILASVLAVSQQEYLDSMKKNKVHRDPPPDKS

SEQ ID NO: 56704 - protein, 288 aa, Homo sapiens
MDDPKSEQQRILRRHQRERQELQAQIRSLKNSVPKTDKTKRKQLLQDVARMEAEMAQKHRQELEKFQDDSSIESVVEDLAKMNLENRPPRSSKAHRKRERMESEERERQESIFQAEMSEHLAGFKREEEEKLAAILGARGLEMKAIPADGHCMYRAIQDQLVFSVSVEMLRCRTASYMKKHVDEFLPFFSNPETSDSFGYDDFMIYCDNIVRTTAWGGQLELRALSHVLKTPIEVIQADSPTLIIGEEYVKKPIILVYLRYAYSLGEHYNSVTPLEAGAAGGVLPRLL

SEQ ID NO: 56705 - protein, 323 aa, Homo sapiens
MEPRVRVEGWKVPTSRCRFLLARVLGYLVVMEAVLTEELDEEEQLLRRHRKEKKELQAKIQGMKNAVPKNDKKRRKQLTEDVAKLEKEMEQKHREELEQLKLTTKENKIDSVAVNISNLVLENQPPRISKAQKRREKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 56706 - protein, 192 aa, Homo sapiens
MISKEKKAALEKEREERIAEAEIENLTGARHMESEKLAQILAARQLEIKQIPSDGHCMYKAIEDQLKEKDCALTVVALRSQTAEYMQSHVEDFLPFLTNPNTGDMYTPEEFQKYCEDIVNTAAWGGQLELRALSHILQTPIEIIQADSPPIIVGEEYSKKPLILVYMRHAYGLGEHYNSVTRLVNIVTENCS

SEQ ID NO: 56707 - protein, 926 aa, Homo sapiens
MVSSVLPNPTSAECWAALLHDPMTLDMDAVLSDFVRSTGAEPGLARDLLEGKNWDLTAALSDYEQLRQVHTANLPHVFNEGRGPKQPEREPQPGHKVERPCLQRQDDIAQEKRLSRGISHASSAIVSLARSHVASECNNEQFPLEMPIYTFQLPDLSVYSEDFRSFIERDLIEQATMVALEQAGRLNWWSTVCTSCKRLLPLATTGDGNCLLHAASLGMWGFHDRDLVLRKALYTMMRTGAEREALKRRWRWQQTQQNKEEEWEREWTELLKLASSEPRTHFSKNGGTGGGVDNSEDPVYESLEEFHVFVLAHILRRPIVVVADTMLRDSGGEAFAPIPFGGIYLPLEVPPNRCHCSPLVLAYDQAHFSALVSMEQRDQQREQAVIPLTDSEHKLLPLHFAVDPGKDWEWGKDDNDNARLAHLILSLEAKLNLLHSYMNVTWIRIPSETRAPLAQPESPTASAGEDVQSLADSLDSDRDSVCSNSNSNNGKNGKDKEKEKQRKEKDKTRADSVANKLGSFSKTLGIKLKKNMGGLGGLVHGKMGRANSANGKNGDSAERGKEKKAKSRKGSKEESGASASTSPSEKTTPSPTDKAAGASPAEKGGGPRGDAWKYSTDVKLSLNILRAAMQGERKFIFAGLLLTSHRHQFHEEMIGYYLTSAQERFSAEQEQRRRDAATAAAAAAAAAAATAKRPPRRPETEGVPVPERASPGPPTQLVLKLKERPSPGPAAGRAARAAAGGTASPGGGARRASASGPVPGRSPPAPARQSVIHVQASGARDEACAPAVGALRPCATYPQQNRSLSSQSYSPARAAALRTVNTVESLARAVPGALPGAAGTAGAAEHKSQTYTNGFGALRDGLEFADADAPTARSNGECGRGGPGPVQRRCQRENCAFYGRAETEHYCSYCYREELRRRREARGARP

SEQ ID NO: 56708 - protein, 933 aa, Homo sapiens
MVSSVLPNPTSAECWAALLHDPMTLDMDAVLSDFVRSTGAEPGLARDLLEGKNWDLTAALSDYEQLRQVHTANLPHVFNEGRGPKQPEREPQPGHKVERPCLQRQDDIAQEKRLSRGISHASSAIVSLARSHVASECNNEQFPLEMPIYTFQLPDLSVYSEDFRSFIERDLIEQATMVALEQAGRLNWWSTVCTSCKRLLPLATTGDGNCLLHAASLGMWGFHDRDLVLRKALYTMMRTGAEREALKRRWRWQQTQQNKESGLVYTEEEWEREWTELLKLASSEPRTHFSKNGGTGGGVDNSEDPVYESLEEFHVFVLAHILRRPIVVVADTMLRDSGGEAFAPIPFGGIYLPLEVPPNRCHCSPLVLAYDQAHFSALVSMEQRDQQREQAVIPLTDSEHKLLPLHFAVDPGKDWEWGKDDNDNARLAHLILSLEAKLNLLHSYMNVTWIRIPSETRAPLAQPESPTASAGEDVQSLADSLDSDRDSVCSNSNSNNGKNGKDKEKEKQRKEKDKTRADSVANKLGSFSKTLGIKLKKNMGGLGGLVHGKMGRANSANGKNGDSAERGKEKKAKSRKGSKEESGASASTSPSEKTTPSPTDKAAGASPAEKGGGPRGDAWKYSTDVKLSLNILRAAMQGERKFIFAGLLLTSHRHQFHEEMIGYYLTSAQERFSAEQEQRRRDAATAAAAAAAAAAATAKRPPRRPETEGVPVPERASPGPPTQLVLKLKERPSPGPAAGRAARAAAGGTASPGGGARRASASGPVPGRSPPAPARQSVIHVQASGARDEACAPAVGALRPCATYPQQNRSLSSQSYSPARAAALRTVNTVESLARAVPGALPGAAGTAGAAEHKSQTYTNGFGALRDGLEFADADAPTARSNGECGRGGPGPVQRRCQRENCAFYGRAETEHYCSYCYREELRRRREARGARP

SEQ ID NO: 56709 - protein, 110 aa, Homo sapiens
MVSSVLPNPTSAECWAALLHDPMTLDMDAVLSDFVRSTGAEPGLARDLLEGKNWDLTAALSDYEQLRQVHTANLPHVFNEGRGPKQPEREPQPGHKVERPCLQRQDDIAQ

SEQ ID NO: 56710 - protein, 843 aa, Homo sapiens
MTLDMDAVLSDFVRSTGAEPGLARDLLEGKNWDVNAALSDFEQLRQVHAGNLPPSFSEGSGGSRTPEKGFSDREPTRPPRPILQRQDDIVQEKRLSRGISHASSSIVSLARSHVSSNGGGGGSNEHPLEMPICAFQLPDLTVYNEDFRSFIERDLIEQSMLVALEQAGRLNWWVSVDPTSQRLLPLATTGDGNCLLHAASLGMWGFHDRDLMLRKALYALMEKGVEKEALKRRWRWQQTQQNKESGLVYTEDEWQKEWNELIKLASSEPRMHLGTNGANCGGVESSEEPVYESLEEFHVFVLAHVLRRPIVVVADTMLRDSGGEAFAPIPFGGIYLPLEVPASQCHRSPLVLAYDQAHFSALVSMEQKENTKEQAVIPLTDSEYKLLPLHFAVDPGKGWEWGKDDSDNVRLASVILSLEVKLHLLHSYMNVKWIPLSSDAQAPLAQPESPTASAGDEPRSTPESGDSDKESVGSSSTSNEGGRRKEKSKRDREKDKKRADSVANKLGSFGKTLGSKLKKNMGGLMHSKGSKPGGVGTGLGGSSGTETLEKKKKNSLKSWKGGKEEAAGDGPVSEKPPAESVGNGGSKYSQEVMQSLSILRTAMQGEGKFIFVGTLKMGHRHQYQEEMIQRYLSDAEERFLAEQKQKEAERKIMNGGIGGGPPPAKKPEPDAREEQPTGPPAESRAMAFSTGYPGDFTIPRPSGGGVHCQEPRRQLAGGPCVGGLPPYATFPRQCPPGRPYPHQDSIPSLEPGSHSKDGLHRGALLPPPYRVADSYSNGYREPPEPDGWAGGLRGLPPTQTKCKQPNCSFYGHPETNNFCSCCYREELRRREREPDGELLVHRF

SEQ ID NO: 56711 - protein, 427 aa, Homo sapiens
MTLDMDAVLSDFVRSTGAEPGLARDLLEGKNWDVNAALSDFEQLRQVHAGNLPPSFSEGSGGSRTPEKGFSDREPTRPPRPILQRQDDIVQEKRLSRGISHASSSIVSLARSHVSSNGGGGGSNEHPLEMPICAFQLPDLTVYNEDFRSFIERDLIEQSMLVALEQAGRLNWWVSVDPTSQRLLPLATTGDGNCLLHAASLGMWGFHDRDLMLRKALYALMEKGVEKEALKRRWRWQQTQQNKESGLVYTEDEWQKEWNELIKLASSEPRMHLGTNGANCGGVESSEEPVYESLEEFHVFVLAHVLRRPIVVVADTMLRDSGGEAFAPIPFGGIYLPLEVPASQCHRSPLVLAYDQAHFSALVSMEQKENTKEQAVIPLTDSEYKLLPLHFAVDPGKGWEWGKDDSDNVRLASVILSLEVKLHLLHS

SEQ ID NO: 56712 - protein, 814 aa, Homo sapiens
MTLDMDAVLSDFVRSTGAEPGLARDLLEGKNWDVNAALSDFEQLRQVHAGNLPPSFSEGSGGSRTPEKGFSDREPTRPPRPILQRQDDIVQEKRLSRGISHASSSIVSLARSHVSSNGGGGGSNEHPLEMPICAFQLPDLTVYNEDFRSFIERDLIEQSMLVALEQAGRLNWWVSVDPTSQRLLPLATTGDGNCLLHAASLGMWGFHDRDLMLRKALYALMEKGVEKEALKRRWRWQQTQQNKESGLVYTEDEWQKEWNELIKLASSEPRMHLGTNGANCGGVESSEEPVYESLEEFHVFVLAHVLRRPIVVVADTMLRDSGGEAFAPIPFGGIYLPLEVPASQCHRSPLVLAYDQAHFSALVSMEQKENTKEQAVIPLTDSEYKLLPLHFAVDPGKGWEWGKDDSDNVRLASVILSLEVKLHLLHSYMNVKWIPLSSDAQAPLAQPESPTASAGDEPRSTPESGDSDKESVGSSSTSNEGGRRKEKSKRDREKDKKRADSVANKLGSFGKTLGSKLKKNMGGLMHSKGSKPGGVGTGLGGSSGTETLEKKKKNSLKSWKGGKEEAAGDGPVSEKPPAESVGNGGSKYSQEVMQSLSILRTAMQGEGKFIFVGTLKMGHRHQYQEEMIQRYLSDAEERFLAEQKQKEAERKIMNGGIGGGPPPAKKPEPDAREEQPTGPPAESRAMAFSTGYPGDFTIPRPSGGGVHCQEPRRQLAGGPCVGGLPPYATFPRQCPPGRPYPHQDSIPSLEPGSHSKDGLHRGALLPPPYRVADSYSNGYREPPEPDGWAGGLRGLPPTQTKCKQPDGELLVHRF

SEQ ID NO: 56713 - protein, 308 aa, Homo sapiens
MCGVEGCCQGGATRRGSLPGGRQLATRKRSVVRRCLKMAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 56714 - protein, 271 aa, Homo sapiens
MAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 56715 - protein, 271 aa, Homo sapiens; identical to SEQ ID NO: 56714

SEQ ID NO: 56716 - protein, 280 aa, Homo sapiens
MAAEEPQQQKQEPLGSDSEGVNCLAYDEAIMAQQDRIQQEDMTDPCLLQIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEPKVYLLYRPGHYDILYK

SEQ ID NO: 56717 - protein, 234 aa, Homo sapiens
MSETSFNLISEKCDILSILRDHPENRIYRRKIEELSKRFTAIRKTKGDGNCFYRALGYSYLESLLGKSREIFKFKERVLQTPNDLLAAGFEEHKFRNFFNAFYSVVELVEKDGSVSSLLKVFNDQSASDHIVQFLRLLTSAFIRNRADFFRHFIDEEMDIKDFCTHEVEPMATECDHIQITALSQALSIALQVEYVDEMDTALNHHVFPEAATPSVYLLYKTSHYNILYAADKH

SEQ ID NO: 56718 - protein, 73 aa, Homo sapiens
MSETSFNLISEKCDILSILRDHPENRIYRRKIEELSKRFTAIRKTKGDGNCFYRALGYSYLESLLGKSREIFK

SEQ ID NO: 56719 - protein, 250 aa, Homo sapiens
MAALSCLLDSVRRDIKKVDRELRQLRCIDEFSTRCLCDLYMHPYCCCDLHPYPYCLCYSKRSRSCGLCDLYPCCLCDYKLYCLRPSLRSLERKAIRAIEDEKRELAKLRRTTNRILASSCCSSNILGSVNVCGFEPDQVKVRVKDGKVCVSAERENRYDCLGSKKYSYMNICKEFSLPPCVDEKDVTYSYGLGSCVKIESPCYPCTSPCSPCSPCSPCNPCSPCNPCSPYDPCNPCYPCGSRFSCRKMIL

SEQ ID NO: 56720 - protein, 805 aa, Homo sapiens
MKDRSSTPPLHVHVDENTPVHVHIKKLPKPSATSSQKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 56721 - protein, 824 aa, Homo sapiens
MKDRSSTPPLHVHVDENTPVHVHIKKLPKPSATSSQKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 56722 - protein, 638 aa, Homo sapiens
MSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 56723 - protein, 829 aa, Homo sapiens
MSASSSGGSPRFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRIEHQGDKLEMAREKHQASQKENKQLSLKVDELERKLEATSAQNIEFLQVIAKREEAIHQSQLRLEEKTRECGTLARQLESAIEDARRQVEQTKEHALSKERAAQNKILDLETQLSRTKTELSQLRRSRDDADRRYQSRLQDLKDRLEQSESTNRSMQNYVQFLKSSYANVFGDGPYSTFLTSSPIRSRSPPA

SEQ ID NO: 56724 - protein, 701 aa, Homo sapiens
MGELPTGCRKRRRKRGGAAARARLHPPRRLHGTTLASDFNDFIRRRFWAQPCRSWFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 56725 - protein, 657 aa, Homo sapiens
MADQQGPHQNRFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 56726 - protein, 189 aa, Homo sapiens
MKDRSSTPPLHVHVDENTPVHVHIKKLPKPSATSSQKSHKRGMKGDTVNVRRSVRVKTKVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTL

SEQ ID NO: 56727 - protein, 205 aa, Homo sapiens
MSASSSGGSPRFPSCGKNGVTSLTQKKVLRAPCGAPSVTVTKSHKRGMKGDTVNVRRSVRVKTKVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKE

SEQ ID NO: 56728 - protein, 180 aa, Homo sapiens
MSASSSGGSPRFPSCGKNGVTSLTQKKVLRAPCGAPSVTVTKSHKRGMKGDTVNVRRSVRVKTKVPWMPPGKSSARPVGCKWENPPHCLEITPPSSEKLVSVMRLSDLSTEDDDSGHCKMNRYDKKIDSLMNAVGCLKSEVKMQKGERQMAKRFLEERKEELEEVAHELAETEHENTVLR

SEQ ID NO: 56729 - protein, 215 aa, Homo sapiens
MKDRSSTPPLHVHVDENTPVHVHIKKLPKPSATSSQKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTVG

SEQ ID NO: 56730 - protein, 156 aa, Homo sapiens
MSASSSGGSPRFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHE

SEQ ID NO: 56731 - protein, 576 aa, Homo sapiens
MKDRSSTPPLHVHVDENTPVHVHIKKLPKPSATSSQKSHKRGMKGDTVNVRRSVRVKTKVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 56732 - protein, 147 aa, Homo sapiens
MKDRSSTPPLHVHVDENTPVHVHIKKLPKPSATSSQKSHKRGMKGDTVNVRRSVRVKTKVPWMPPGKSSARPVGCKWETSEETPTTGEGVPHVQAGGGGNGWGCGCQAGHGLEGYHREAENRETNDLHGHQHPDKAEGTSPAEAEHI

SEQ ID NO: 56733 - protein, 638 aa, Homo sapiens
MGRNRYPPACWFPSCGKNGVTSLTQKKVLRAPCGAPSVTVTKSHKRGMKGDTVNVRRSVRVKTKNPPHCLEITPPSSEKLVSVMRLSDLSTEDDDSGHCKMNRYDKKIDSLMNAVGCLKSEVKMQKGERQMAKRFLEERKEELEEVAHELAETEHENTVLRHNIERMKEEKDFTILQKKHLQQEKECLMSKLVEAEMDGAAAAKQVMALKDTIGKLKTEKQMTCTDINTLTRQKELLLQKLSTFEETNRTLRDLLREQHCKEDSERLMEQQGALLKRLAEADSEKARLLLLLQDKDKEVEELLQEIQCEKAQAKTASELSKSMESMRGHLQAQLRSKEAENSRLCMQIKNLERSGNQHKAEVEAIMEQLKELKQKGDRDKESLKKAIRAQKERAEKSEEYAEQLHVQLADKDLYVAEALSTLESWRSRYNQVVKEKGDLELEIIVLNDRVTDLVNQQQTLEEKMREDRDSLVERLHRQTAEYSAFKLENERLKASFAPMEDKLNQAHLEVQQLKASVKNYEGMIDNYKSQVMKTRLEADEVAAQLERCDKENKILKDEMNKEIEAARRQFQSQLADLQQLPDILKITEAKLAECQDQLQGYERKNIDLTAIISDLRSRVRDWQKGSHELTRAGARIPR

SEQ ID NO: 56734 - protein, 254 aa, Homo sapiens
MTEEVWMGTWRPHRPRGPIMALYSSPGPKYLIPPTTGFMKHTPTKLRAPAYSFRGAPMLLAENCSPGPRYNVNPKILRTGKDLGPAYSILGRYQTKTMLTPGPGDYFPEKSTKYVFDSAPSHSISARTKAFRVDSTPGPAAYMLPMVMGPNTVGKASQPSFSIKGRSKLGGFSDDLHKTPGPAAYRQTDVRVTKFKAPQYTMAARVEPPGDKTLKPGPGAHSPEKVTLTKPCAPVVTFGIKHSDYMTPLLVDVE

SEQ ID NO: 56735 - protein, 138 aa, Homo sapiens
MTEEVWMGTWRPHRPRGPIMALYSSPGPKYLIPPTTGFMKHTPTKLRAPAYSFRGAPMLLAENCSPGPRYNVNPKILRTGKDLGPAYSILGRYQTKTMLTPGPALKSAFPSWTPPDPTWSPPVLEPRGPTPRMLGSPP

SEQ ID NO: 56736 - protein, 124 aa, Homo sapiens
MTEEVWMGTWRPHRPRGPIMALYSSPGPKYLIPPTTGFMKHTPTKLRAPAYSFRGAPMLLAENCSPPNTVGKASQPSFSIKGRSKLGGFSDDLHKVTLTKPCAPVVTFGIKHSDYMTPLLVDVE

SEQ ID NO: 56737 - protein, 257 aa, Homo sapiens
MDAEYSGNEFPRSEGERDQHQRPGKERKSGEAGWGTGELGQDGRLLSSTLSLSSNRSLGQRQNSPLPFQWRITHSFRWMAQVLASELSLVAFILLLVVAFSKKWLDLSRSLFYQRWPVDVSNRIHTSAHVMSMGLLHFYKSRSCSDLENGKVTFIFSTLMLFPINIWIFELERNVSIPIGWSYFIGWLVLILYFTCAILCYFNHKSFWSLILSHPSGAVSCSSSFGSVEESPRAQTITDTPITQEGVLDPEQKDTHV

SEQ ID NO: 56738 - protein, 495 aa, Homo sapiens
MVTWLYRFLPTSNMAAKLRSLLPPDLRLQFWLHARLQKCFLSRGCGSYCAGAKASPLPGKMAMGLMCGRRELLRLLQSGRRVHSVAGPSQWLGKPLTTRLLFPAAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSKPKSKYPWHDTLG

SEQ ID NO: 56739 - protein, 419 aa, Homo sapiens
MRGTQVHSVAGPSQWLGKPLTTRLLFPAAPCCCRPHYLFLAASGPRSLSTSAISFAEVQVQAPPVVAATPSPTAVPEVASGETADVVQTAAEQSFAELGLGSYTPVGLIQNLLEFMHVDLGLPWWGAIAACTVFARCLIFPLIVTGQREAARIHNHLPEIQKFSSRIREAKLAGDHIEYYKASSEMALYQKKHGIKLYKPLILPVTQAPIFISFFIALREMANLPVPSLQTGGLWWFQDLTVSDPIYILPLAVTATMWAVLELGAETGVQSSDLQWMRNVIRMMPLITLPITMHFPTAVFMYWLSSNLFSLVQVSCLRIPAVRTVLKIPQRVVHDLDKLPPREGFLESFKKGWKNAEMTRQLREREQRMRNQLELAARGPLRQTFTHNPLLQPGKDNPPNIPSSSSKPKSKYPWHDTLG

SEQ ID NO: 56740 - protein, 243 aa, Homo sapiens
MSRLWYGKKGRRHQPINHKYTLVVSVAEYHRRIDALNTEELRTLCRRLQITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 56741 - protein, 839 aa, Homo sapiens
MDYLTTFTEKSGRLLRGTANRLLGFGGGGEARQVRFEDYLREPAQGDLGCGSPPHRPPAPSSPEGPDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 56742 - protein, 874 aa, Homo sapiens
MTKDKNSPGLKKKSQSVDINAPGFNPLAGAGKQTPQASKPPAPKTPIIEEEQNNAANTQKHPSRRSELKRFYTIDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEVVSVAEYHRRIDALNTEELRTLCRRLQITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 56743 - protein, 846 aa, Homo sapiens
MSVSNLSWLKKKSQSVDINAPGFNPLAGAGKQTPQASKPPAPKTPIIEEEQNNAANTQKHPSRRSELKRFYTIDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 56744 - protein, 216 aa, Homo sapiens
MSRLWYGKKGRRHQPINHKYTLITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 56745 - protein, 294 aa, Homo sapiens
MQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWELTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 56746 - protein, 503 aa, Homo sapiens
MFCQRKDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESKCYRVNEVSSSNCMVSPSFLTDSKAAVP

SEQ ID NO: 56747 - protein, 873 aa, Homo sapiens
MSVSNLSWLKKKSQSVDINAPGFNPLAGAGKQTPQASKPPAPKTPIIEEEQNNAANTQKHPSRRSELKRFYTIDTGQKKTLDKKDGRRMSFQKPKGTIEYTVESRDSLNSIALKFDTTPNELVQLNKLFSRAVVTGQVLYVPDPEYVSSVESSPSLSPVSPLSPTSSEAEFDKTTNPDVHPTEATPSSTFTGIRPARVVSSTSEEEEAFTEKFLKINCKYITSGKGTVSGVLLVTPNNIMFDPHKNDPLVQENGCEEYGIMCPMEEVMSAAMYKEILDSKIKESLPIDIDQLSGRDFCHSKKMTGSNTEEIDSRIRDAGNDSASTAPRSTEESLSEDVFTESELSPIREELVSSDELRQDKSSGASSESVQTVNQAEVESLTVKSESTGTPGHLRSDTEHSTNEVGTLCHKTDLNNLEMAIKEDQIADNFQGISGPKEDSTSIKGNSDQDSFLHENSLHQEESQKENMPCGETAEFKQKQSVNKGKQGKEQNQDSQTEAEELRKLWKTHTMQQTKQQRENIQQVSQKEAKHKITSADGHIESSALLKEKQRHRLHKFLCLRVGKPMRKTFVSQASATMQQYAQRDKKHEYWFAVPQERTDHLYAFFIQWSPEIYAEDTGEYTREPGFIVVKKIEESETIEDSSNQAAAREWEVVSVAEYHRRIDALNTEELRTLCRRLQITTREDINSKQVATVKADLESESFRPNLSDPSELLLPDQIEKLTKHLPPRTIGYPWTLVYGTGKHGTSLKTLYRTMTGLDTPVLMVIKDSDGQVFGALASEPLKVSDGFYGTGETFVFTFCPEFEVFKWTGDNMFFIKGDMDSLAFGGGGGEFALWLDGDLYHGRSHSCKTFGNRTLSKKEDFFIQDIEIWAFE

SEQ ID NO: 56748 - protein, 846 aa, Homo sapiens; identical to SEQ ID NO: 56743

SEQ ID NO: 56749 - protein, 273 aa, Homo sapiens
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLDFIQQAISYSSFPFWMGLSRRNPSYPWLWEDGSPLMPHLFRVRGAVSQTYPSGTCAYIQRGAVYAENCILAAFSICQKKANLRAQ

SEQ ID NO: 56750 - protein, 181 aa, Homo sapiens
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSGLHPASNFLFQFSILDGAVSEEPQLPMALGGRFSFDAPLI

SEQ ID NO: 56751 - protein, 189 aa, Homo sapiens
MTFDDLKIQTVKDQPDEKSNGKKAKGLQFLYSPWWCLAAATLGVLCLGLVVTIMVLGMQLSQVSDLLTQEQANLTHQKKKLEGQISARQQAEEASQESENELKEMIETLARKLNEKSKEQMELHHQNLNLQETLKRVANCSAPCPQDWIWHGENCYLFSSGSFNWEKSQEKCLSLDAKLLKINSTADLI

SEQ ID NO: 56752 - protein, 1023 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 56753 - protein, 211 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLE

SEQ ID NO: 56754 - protein, 427 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQIRGHHVAQLDPLGILDADLDSSVPADIISSTDKLGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVRPRERRARQIVKAPCSSMEFRSPT

SEQ ID NO: 56755 - protein, 974 aa, Homo sapiens
MYCAWLENPKSVHKSWDIFFRNTNAGAPPGTAYQSPLPLSRGSLAAVAHAQSLVEAQPNVDKLVEDHLAVQSLIRAYQVRGHHIAKLDPLGISCVNFDDAPVTVSSNVDLAVFKERLRMLTVGGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 56756 - protein, 1019 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPGTAYQSPLPLSRGSLAAVAHAQSLVEAQPNVDKLVEDHLAVQSLIRAYQVRGHHIAKLDPLGISCVNFDDAPVTVSSNVGFYGLDESDLDKVFHLPTTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGSGDVKYHLGMYHRRINRVTDRNITLSLVANPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFELGFAMASPNALVLWEAQFGDFHNTAQCIIDQFICPGQAKWVRQNGIVLLLPHGMEGMGPEHSSARPERFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEQLSPFPFDLLLKEVQKYPNAELAWCQEEHKNQGYYDYVKPRLRTTISRAKPVWYAGRDPAAAPATGNKKTHLTELQRLLDTAFDLDVFKNFS

SEQ ID NO: 56757 - protein, 807 aa, Homo sapiens
MAATELRGVVGPGPAAIAALGGGGAGPPVVGGGGGRGDAGPGSGAASGTVVAAAAGGPGPGAGGVAAAGPAPAPPTGGSGGSGAGGSGSAREGWLFKWTNYIKGYQRRWFVLSNGLLSYYRSKAEMRHTCRGTINLATANITVEDSCNFIISNGGAQTYHLKASSEVERQRWVTALELAKAKAVKMLAESDESGDEESVSQTDKTELQNTLRTLSSKVEDLSTCNDLIAKHGTALQRSLSELESLKLPAESNEKIKQVNERATLFRITSNAMINACRDFLMLAQTHSKKWQKSLQYERDQRIRLEETLEQLAKQHNHLERAFRGATVLPANTPGNVGSGKDQCCSGKGDMSDEDDENEFFDAPEIITMPENLGHKRTGSNISGASSDISLDEQYKHQLEETKKEKRTRIPYKPNYSLNLWSIMKNCIGKELSKIPMPVNFNEPLSMLQRLTEDLEYHELLDRAAKCENSLEQLCYVAAFTVSSYSTTVFRTSKPFNPLLGETFELDRLEENGYRSLCEQVSHHPPAAAHHAESKNGWTLRQEIKITSKFRGKYLSIMPLGTIHCIFHATGHHYTWKKVTTTVHNIIVGKLWIDQSGEIDIVNHKTGDKCNLKFVPYSYFSRDVARKVTGEVTDPSGKVHFALLGTWDEKMECFKVQPVIGENGGDARQRGHEAEESRVMLWKRNPLPKNAENMYYFSELALTLNAWESGTAPTDSRLRPDQRLMENGRWDEANAEKQRLEEKQRLSRKKREAEAMKATEDGTPYDPYKALWFERKKDPVTKELTHIYRGEYWECKEKQDWSSCPDIF

SEQ ID NO: 56758 - protein, 407 aa, Homo sapiens
MAATELRGVVGPGPAAIAALGGGGAGPPVVGGGGGRGDAGPGSGAALQRLTEDLEYHELLDRAAKCENSLEQLCYVAAFTVSSYSTTVFRTSKPFNPLLGETFELDRLEENGYRSLCEQVSHHPPAAAHHAESKNGWTLRQEIKITSKFRGKYLSIMPLGTIHCIFHATGHHYTWKKVTTTVHNIIVGKLWIDQSGEIDIVNHKTGDKCNLKFVPYSYFSRDVARKVTGEVTDPSGKVHFALLGTWDEKMECFKVQPVIGENGGDARQRGHEAEESRVMLWKRNPLPKNAENMYYFSELALTLNAWESGTAPTDSRLRPDQRLMENGRWDEANAEKQRLEEKQRLSRKKREAEAMKATEDGTPYDPYKALWFERKKDPVTKELTHIYRGEYWECKEKQDWSSCPDIF

SEQ ID NO: 56759 - protein, 916 aa, Homo sapiens
MGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 56760 - protein, 874 aa, Homo sapiens
MGKAAAPSRGGGCGGRSRGLSSLFTVVPCLSCHTAAPGMSASTSGSGPEPKPQPQPVPEPERGPLSEQVSEAVSEAVPRSEPVSETTSEPEPGAGQPSELLQGSRPGSESSSGVGAGPFTKAASEPLSRAVGSATFLRPESGSLPALKPLPLLRPGQAKTPLGVPMSGTGTTSSAPLALLPLDSFEGWLLKWTNYLKGYQRRWFVLGNGLLSYYRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEGEAGREGRPGGEERGARVGVPQGRIPGEQATSPPTSPLCLPSREGGGCLHATVV

SEQ ID NO: 56761 - protein, 750 aa, Homo sapiens
MHRQRTRTMSSLAAKRLGMNRRPAGSGGGGGEAATWGHRFWRPQERPTDRNQGEMAHTCRGTINLSTAHIDTEDSCGILLTSGARSYHLKASSEVDRQQWITALELAKAKAVRVMNTHSDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 56762 - protein, 659 aa, Homo sapiens
MKGRGCWDTASVRSFCSSGCLNKFKKDDSGDDDEATTPADKSELHHTLKNLSLKLDDLSTCNDLIAKHGAALQRSLTELDGLKIPSESGEKLKVVNERATLFRITSNAMINACRDFLELAEIHSRKWQRALQYEQEQRVHLEETIEQLAKQHNSLERAFHSAPGRPANPSKSFIEGSLLTPKGEDSEEDEDTEYFDAMEDSTSFITVITEAKEDSRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEAEKEADAYTPLWFEKRLDPLTGEMACVYKGGYWEAKEKQDWHMCPNIF

SEQ ID NO: 56763 - protein, 460 aa, Homo sapiens
MEDSTSFITVITEAKEDRKAEGSTGTSSVDWSSADNVLDGASLVPKGSSKVKRRVRIPNKPNYSLNLWSIMKNCIGRELSRIPMPVNFNEPLSMLQRLTEDLEYHHLLDKAVHCTSSVEQMCLVAAFSVSSYSTTVHRIAKPFNPMLGETFELDRLDDMGLRSLCEQVSHHPPSAAHYVFSKHGWSLWQEITISSKFRGKYISIMPLGAIHLEFQASGNHYVWRKSTSTVHNIIVGKLWIDQSGDIEIVNHKTNDRCQLKFLPYSYFSKEAARKVTGVVSDSQGKAHYVLSGSWDEQMECSKVMHSSPSSPSSDGKQKTVYQTLSAKLLWKKYPLPENAENMYYFSELALTLNEHEEGVAPTDSRLRPDQRLMEKGRWDEANTEKQRLEEKQRLSRRRRLEACGPGSSCSSEEEKEADAYTPLWFEKRLDPLTGEMACVYKGGYWEAKEKQDWHMCPNIF

SEQ ID NO: 56764 - protein, 764 aa, Homo sapiens
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKSAPSSRSRSLTLLPHGTPNSASPCSQRHLSVGAPGVVTITHHKSPAAARRAKSQYSGQLHEVREMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 56765 - protein, 700 aa, Homo sapiens
MERAVQGTDGGGGSNSSSRSSSRATSAGSSPSCSLAGRGVSSRSAAAGLGGGGSRSSPGSVAASPSGGGGRRREPALEGVLSKYTNLLQGWQNRYFVLDFEAGILQYFVNEQSKHQKPRGVLSLSGAIVSLSDEAPHMLVVYSANGEMFKLRAADAKEKQFWVTQLRACAKYHMEMNSKMMNQVEGQQKNLVHAIESLPGSGPLTALDQDLLLLKATSAATLSCLGECLNLLQQSVHQAGQPSQKPGASENILGWHGSKSHSTEQLKNGTLGSLPSASANITWAILPNSAEDEQTSQPEPEPNSGSELVLSEDEKSDNEDKEETELGVMEDQRSIILHLISQLKLGMDLTKVVLPTFILEKRSLLEMYADFMAHPDLLLAITAGATPEERVICFVEYYLTAFHEGRKGALAKKPYNPIIGETFHCSWEVPKDRVKPKRTASRSPASCHEHPMADDPSKSYKLRFVAEQVSHHPPISCFYCECEEKRLCVNTHVWTKSKFMGMSVGVSMIGEGVLRLLEHGEEYVFTLPSAYARSILTIPWVELGGKVSINCAKTGYSATVIFHTKPFYGGKVHRVTAEVKHNPTNTIVCKAHGEWNGTLEFTYNNGETKVIDTTTLPVYPKKIRPLEKQGPMESRNLWREVTRYLRLGDIDAATEQKRHLEEKQRVEERKRENLRTPWKPKYFIQEGDGWVYFNPLWKAH

SEQ ID NO: 56766 - protein, 747 aa, Homo sapiens
MQGGEPVSTMKVSESEGKLEGQATAVTPNKNSSCGGGISSSSSSRGGSAKGWQYSDHMENVYGYLMKYTNLVTGWQYRFFVLNNEAGLLEYFVNEQSRNQKPRGTLQLAGAVISPSDEDSHTFTVNAASGEQYKLRATDAKERQHWVSRLQICTQHHTEAIGKNNPPLKSRSFSLASSSNSPISQRRPSQNAISFFNVGHSKLQSLSKRTNLPPDHLVEVREMMSHAEGQQRDLIRRIECLPTSGHLSSLDQDLLMLKATSMATMNCLNDCFHILQLQHASHQKGSLPSGTTIEWLEPKISLSNHYKNGADQPFATDQSKPVAVPEEQPVAESGLLAREPEEINADDEIEDTCDHKEDDLGAVEEQRSVILHLLSQLKLGMDLTRVVLPTFILEKRSLLEMYADFMSHPDLFIAITNGATAEDRMIRFVEYYLTSFHEGRKGAIAKKPYNPIIGETFHCSWKMPKSEVASSVFSSSSTQGVTNHAPLSGESLTQVGSDCYTVRFVAEQVSHHPPVSGFYAECTERKMCVNAHVWTKSKFLGMSIGVTMVGEGILSLLEHGEEYTFSLPCAYARSILTVPWVELGGKVSVNCAKTGYSASITFHTKPFYGGKLHRVTAEVKHNITNTVVCRVQGEWNSVLEFTYSNGETKYVDLTKLAVTKKRVRPLEKQDPFESRRLWKNVTDSLRESEIDKATEHKHTLEERQRTEERHRTETGTPWKTKYFIKEGDGWVYHKPLWKIIPTTQPAE

SEQ ID NO: 56767 - protein, 950 aa, Homo sapiens
MNTEAEQQLLHHARNGNAEEVRQLLETMARNEVIADINCKGRSKSNLGWTPLHLACYFGHRQVVQDLLKAGAEVNVLNDMGDTPLHRAAFTGRKELVMLLLEYNADTTIVNGSGQTAKEVTHAEEIRSMLEAVERTQQRKLEELLLAAAREGKTTELTALLNRPNPPDVNCSDQLGNTPLHCAAYRAHKQCALKLLRSGADPNLKNKNDQKPLDLAQGAEMKHILVGNKVIYKALKRYEGPLWKSSRFFGWRLFWVVLEHGVLSWYRKQPDAVHNIYRQGCKHLTQAVCTVKSTDSCLFFIKCFDDTIHGFRVPKNSLQQSREDWLEAIEEHSAYSTHYCSQDQLTDEEEEDTVSAADLKKSLEKAQSCQQRLDREISNFLKMIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 56768 - protein, 568 aa, Homo sapiens
MIKECDMAKEMLPSFLQKVEVVSEASRETCVALTDCLNLFTKQEGVRNFKLEQEQEKNKILSEALETLATEHHELEQSLVKGSPPASILSEDEFYDALSDSESERSLSRLEAVTARSFEEEGEHLGSRKHRMSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 56769 - protein, 100 aa, Homo sapiens
MNTEAEQQLLHHARNGNAEEVRQLLETMARNEVIADINCKGRSKSNLGWTPLHLACYFGHRQVVQDLLKAGAEVNVLNDMGDTPLHRAAFTGRKICSQGS

SEQ ID NO: 56770 - protein, 437 aa, Homo sapiens
MSEEKDCGGGDALSNGIKKHRTSLPSPMFSRNDFSIWSILRKCIGMELSKITMPVIFNEPLSFLQRLTEYMEHTYLIHKASSLSDPVERMQCVAAFAVSAVASQWERTGKPFNPLLGETYELVRDDLGFRLISEQVSHHPPISAFHAEGLNNDFIFHGSIYPKLKFWGKSVEAEPKGTITLELLEHNEAYTWTNPTCCVHNIIVGKLWIEQYGNVEIINHKTGDKCVLNFKPCGLFGKELHKVEGYIQDKSKKKLCALYGKWTECLYSVDPATFDAYKKNDKKNTEEKKNSKQMSTSEELDEMPVPDSESVFIIPGSVLLWRIAPRPPNSAQMYNFTSFAMVLNEVDKDMESVIPKTDCRLRPDIRAMENGEIDQASEEKKRLEEKQRAARKNRSKSEEDWKTRWFHQGPNPYNGAQDWIYSGSYWDRNYFNLPDIY

SEQ ID NO: 56771 - protein, 114 aa, Homo sapiens
MQSVAAFAVSAVASQWERTGKPFNPLLGETYELIREDLGFRFISEQVSHHPPISAFHSEGLNHDFLFHGSIYPKLKFWGKSVEAEPRGTITLELLNVNQRHLRAKHKSPTNAGR

SEQ ID NO: 56772 - protein, 480 aa, Homo sapiens
MNGEEEFFDAVTGFDSDNSSGEFSEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 56773 - protein, 468 aa, Homo sapiens
MNGEEEFFDAVTEANQKVTGMIDLDTSKNNRIGKTGERPSQENGIQKHRTSLPAPMFSRSDFSVWTILKKCVGLELSKITMPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQMYNFTSFTVSLNELETGMEKTLPPTDCRLRPDIRGMENGNMDLASQEKERLEEKQREARRERAKEEAEWQTRWFYPGNNPYTGTPDWLYAGDYFERNFSDCPDIY

SEQ ID NO: 56774 - protein, 370 aa, Homo sapiens
MPIAFNEPLSFLQRITEYMEHVYLIHRASCQPQPLERMQSVAAFAVSAVASQWERTGKPFNPLLGETYELIREDLGFRFISEQVSHHPPISAFHSEGLNHDFLFHGSIYPKLKFWGKSVEAEPRGTITLELLKHNEAYTWTNPTCCVHNVIIGKLWIEQYGTVEILNHRTGHKCVLHFKPCGLFGKELHKVEGHIQDKNKKKLFMIYGKWTECLWGIDPVSYESFKKQERRGDHLRKAKLDEDSGKADSDVADDVPVAQETVQVIPGSKLLWRINTRPPNSAQIWPARRRSGWRRSREKHGGSGPRRRQSGRRGGSTQAITPTLGPPTGCMQGITLSGISPTAQISTEGLEGPGARDRRLTRLDFLEWPL

SEQ ID NO: 56775 - protein, 112 aa, Homo sapiens
SVAAFAVSAVASQWERTGKPFNPLLGETYELIREDLGFRFISEQVSHHPPISAFHSEGLNHDFLFHGSIYPKLKFWGKSVEAEPRGTITLELLNVNQRHLRAKHKSPTNAGR

SEQ ID NO: 56776 - protein, 887 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 56777 - protein, 856 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSALAQNTDLKERLRRIHAESLLLDSPAVAKSGDNLAEENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 56778 - protein, 851 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQGGSFESPKKEKRSHRRWRSRAIGKDAKGTLQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 56779 - protein, 851 aa, Homo sapiens; identical to SEQ ID NO: 56778

SEQ ID NO: 56780 - protein, 856 aa, Homo sapiens; identical to SEQ ID NO: 56777

SEQ ID NO: 56781 - protein, 820 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSSKCIDLDTEEHIYHLKVKSEEVFDEWVSKLRHHRMYRQNEIAMFPHEVNHFFSGSTITDSSSGVFDSISSRKRSSISKQNLFQTGSNVSFSCGGETRVPLWLQSSEDMEKCSKDLAHCHAYLVEMSQLLQSMDVLHRTYSAPAINAIQVPKPFSGPVRLHSSNPNLSTLDFGEEKNYSDGSETSSEFSKMQEDLCHIAHKVYFTLRSAFNIMSAEREKLKQLMEQDASSSPSAQVIGLKNALSSENSRDENRALVHQLSNESRLSITDSLSEFFDAQEVLLSPSSSENEISDDDSYVSDISDNLSLDNLSNDLDNERQTLGPVLDSGREAKSRRRTCLPAPCPSSSNISLWNILRNNIGKDLSKVAMPVELNEPLNTLQRLCEELEYSELLDKAAQIPSPLERMVYVAAFAISAYASSYYRAGSKPFNPVLGETYECIREDKGFQFFSEQVSHHPPISACHAESRNFVFWQDVRWKNKFWGKSMEIVPIGTTHVTLPVFGDHFEWNKVTSCIHNILSGQRWIEHYGEIVIKNLHDDSCYCKVNFIKAKYWSTNAHEIEGTVFDRSGKAVHRLFGKWHESIYCGGGSSSACVWRANPMPKGYEQYYSFTQFALELNEMDPSSKSLLPPTDTRFRPDQRFLEEGNLEEAEIQKQRIEQLQRERRRVLEENHVEHQPRFFRKSDDDSWVSNGTYLELRKDLGFSKLDHPVLW

SEQ ID NO: 56782 - protein, 112 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTDIEREKLHGCIDVGLSVMSVKKSS

SEQ ID NO: 56783 - protein, 61 aa, Homo sapiens
MMSDEKNLGVSQKLVSPSRSTSSCSSKQGSRQDSWEVVEGLRGEMNYTQEPPVQKGFLLKK

SEQ ID NO: 56784 - protein, 820 aa, Homo sapiens; identical to SEQ ID NO: 56781

SEQ ID NO: 56785 - protein, 89 aa, Homo sapiens
MMSDEKNLGVSQKLVSPSRSTSSCSSKQGSRQDSWEVVEGLRGEMNYTQEPPVQKGFLLKKRKWPLKGWHKRFFYLDKGILKYAKSQTD

SEQ ID NO: 56786 - protein, 879 aa, Homo sapiens
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKIRGTLKSWTKLWCVLKPGVLLIYKTPKVGQWVGTVLLHCCELIERPSKKDGFCFKLFHPLDQSVWAVKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 56787 - protein, 811 aa, Homo sapiens
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKGPKGESVGSITQPLPSSYLIFRAASESDGRCWLDALELALRCSSLLRLGTCKPGRDGEPGTSPDASPSSLCGLPASATVHPDQDLFPLNGSSLENDAFSDKSERENPEESDTETQDHSRKTESGSDQSETPGAPVRRGTTYVEQVQEELGELGEASQVETVSEENKSLMWTLLKQLRPGMDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 56788 - protein, 439 aa, Homo sapiens
MDLSRVVLPTFVLEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELHGTGSTGTDPRPPAEPPILVPALRVPGVSAVH

SEQ ID NO: 56789 - protein, 811 aa, Homo sapiens; identical to SEQ ID NO: 56787

SEQ ID NO: 56790 - protein, 124 aa, Homo sapiens
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDP

SEQ ID NO: 56791 - protein, 98 aa, Homo sapiens
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKET

SEQ ID NO: 56792 - protein, 139 aa, Homo sapiens
MKEEAFLRRRFSLCPPSSTPQKVDPRKLTRNLLLSGDNELYPLSPGKDMEPNGPSLPRDEGPPTPSSATKVPPAEYRLCNGSDKECVSPTARVTKKETLKAQKENYRQEKKRATRQLLSALTDPSVVIMADSLKIRGTL

SEQ ID NO: 56793 - protein, 90 aa, Homo sapiens
MKEEAFLRRRFSLCPPSSTPQKVDPRKLTRNLLLSGDNELYPLSPGKDMEPNGPSLPRDEGPPTPSSATKVPPAEYRLCNGSDKECVSPT

SEQ ID NO: 56794 - protein, 69 aa, Homo sapiens
MKEEAFLRRRFSLCPPSSTPQKVDPRKLTRNLLLSGDNELYPLSPGKDMEPNGPSLPRDEGPPTPSSAT

SEQ ID NO: 56795 - protein, 432 aa, Homo sapiens
YNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 56796 - protein, 510 aa, Homo sapiens
MCVPHRQGHQEGDSQGAEGELPAGEEPRSFLNKLSDYYYHADLLSRAAVEEDAYSRMKLVLRWYLSGFYKKPKGIKKPYNPILGETFRCCWFHPQTDSRTFYIAEQVSHHPPVSAFHVSNRKDGFCISGSITAKSRFYGNSLSALLDGKATLTFLNRAEDYTLTMPYAHCKGILYGTMTLELGGKVTIECAKNNFQAQLEFKLKPFFGGSTSINQISGKITSGEEVLASLSGHWDRDVFIKEEGSGSSALFWTPSGEVRRQRLRQHTVPLEEQTELESERLWQHVTRAISKGDQHRATQEKFALEEAQRQRARERQESLMPWKPQLFHLDPITQEWHYRYEDHSPWDPLKDIAQFEQDGILRTLQQEAVARQTTFLGSPGPRHERSGPDQRLRKASDQPSGHSQATESSGSTPESCPELSDEEQDGDFVPGGESPCPRCRKEARRLQALHEAILSIREAQQELHRHLSAMLSSTARAAQAPTPGLLQSPRSWFLLCVFLACQLFINHILK

SEQ ID NO: 56797 - protein, 934 aa, Homo sapiens
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 56798 - protein, 938 aa, Homo sapiens
MHQLSLIRGNRGRSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQEGPPAKGQFSTTRRRQRLAAAVATTVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 56799 - protein, 898 aa, Homo sapiens
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 56800 - protein, 190 aa, Homo sapiens
MDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQVPFSATMSPVRLHSSNPNLCADIEFQTPPPNHFGILSVLLQPYSLKKKKKKKKKSTPSLESRIKGAEYKIQSLTSL

SEQ ID NO: 56801 - protein, 959 aa, Homo sapiens
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQANCVDISKKDKRVTRRWRTKSVSKDTKIQLQEGPPAKGQFSTTRRRQRLAAAVATTVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 56802 - protein, 903 aa, Homo sapiens
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDSEEMDRCAEDLAHCQSNLVELSKLLQNLEILQRTQSAPNFTDMQVPFSATMSPVRLHSSNPNLCADIEFQTPPSHLTDPLESSTDYTKLQEEFCLIAQKVHSLLKSAFNSIAIEKEKLKQMVSEQDHSKGHSTQMARLRQSLSQALNQNAELRSRLNRIHSESIICDQVVSVNIIPSPDEAGEQIHVSLPLSQQVANESRLSMSESVSEFFDAQEVLLSASSSENEASDDESYISDVSDNISEDNTSVADNISRQILNGELTGGAFRNGRRACLPAPCPDTSNINLWNILRNNIGKDLSKVSMPVELNEPLNTLQHLCEEMEYSELLDKASETDDPYERMVLVAAFAVSGYCSTYFRAGSKPFNPVLGETYECIREDKGFRFFSEQVSHHPPISACHCESKNFVFWQDIRWKNKFWGKSMEILPVGTLNVMLPKYGDYYVWNKVTTCIHNILSGRRWIEHYGEVTIRNTKSSVCICKLTFVKVNYWNSNMNEVQGVVIDQEGKAVYRLFGKWHEGLYCGVAPSAKCIWRPGSMPTNYELYYGFTRFAIELNELDPVLKDLLPPTDARFRPDQRFLEEGNLEAAASEKQRVEELQRSRRRYMEENNLEHIPKFFKKVIDANQREAWVSNDTYWELRKDPGFSKVDSPVLW

SEQ ID NO: 56803 - protein, 842 aa, Homo sapiens
MDFQERDPPFLPESAQSSKPSSAQQASELWEVVEEPRVRLGTEGVMPERQEGHLLKKRKWPLKGWHKRYFVLEDGILHYATTRQDITKGKLHGSIDVRLSVMSINKKAQRIDLDTEDNIYHLKIKSQDLFQSWVAQLRAHRLAHRLDMPRGSLPSTAHRKVPGAQLPTAATASALPGLGPREKVSSWLRDSDGLDRCSHELSECQGKLQELHRLLQSLESLHRIPSAPVIPTHQASVTTERPKKGKRTSRMWCTQSFAKDDTIGRVGRLHGSVPNLSRYLESRDSSGTRGLPPTDYAHLQRSFWALAQKVHSSLSSVLAALTMERDQLRDMHQGSELSRMGVSEASTGQRRLHSLSTSSDTTADSFSSLNPEEQEALYMKGRELTPQLSQTSILSLADSHTEFFDACEVLLSASSSENEGSEEEESCTSEITTSLSEEMLDLRGAERCQKGGCVPGRPMGPPRRRCLPAASGPGADVSLWNILRNNIGKDLSKVSMPVQLNEPLNTLQRLCEELEYSSLLDQASRIADPCERMVYIAAFAVSAYSSTYHRAGCKPFNPVLGETYECERPDRGFRFISEQVSHHPPISACHAESENFAFWQDMKWKNKFWGKSLEIVPVGTVNVSLPRFGDHFEWNKVTSCIHNVLSGQRWIEHYGEVLIRNTQDSSCHCKITFCKAKYWSSNVHEVQGAVLSRSGRVLHRLFGKWHEGLYRGPTPGGQCIWKPNSMPPDHERNFGFTQFALELNELTAELKRSLPSTDTRLRPDQRYLEEGNIQAAEAQKRRIEQLQRDRRKVMEENNIVHQARFFRRQTDSSGKEWWVTNNTYWRLRAEPGYGNMDGAVLW

SEQ ID NO: 56804 - protein, 842 aa, Homo sapiens; identical to SEQ ID NO: 56803

SEQ ID NO: 56805 - protein, 889 aa, Homo sapiens
MEGGLADGEPDRTSLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 56806 - protein, 847 aa, Homo sapiens
MSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 56807 - protein, 847 aa, Homo sapiens; identical to SEQ ID NO: 56806

SEQ ID NO: 56808 - protein, 728 aa, Homo sapiens
MEGGLADGEPDRTSLLGDSKDVLGPSTVVANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEKKK

SEQ ID NO: 56809 - protein, 874 aa, Homo sapiens
MEGGLADGEPDRTSANSDESQLLTPGKMSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMADWLKIRGTLKSWTKLWCVLKPGVLLIYKTQKNGQWVGTVLLNACEIIERPSKKDGFCFKLFHPLEQSIWAVKGPKGEAVGSITQPLPSSYLIIRATSESDGRCWMDALELALKCSSLLKRTMIREGKEHDLSVSSDSTHVTFYGLLRANNLHSGDNFQLNDSEIERQHFKDQDMYSDKSDKENDQEHDESDNEVMGKSEESDTDTSERQDDSYIEPEPVEPLKETTYTEQSHEELGEAGEASQTETVSEENKSLIWTLLKQVRPGMDLSKVVLPTFILEPRSFLDKLSDYYYHADFLSEAALEENPYFRLKKVVKWYLSGFYKKPKGLKKPYNPILGETFRCLWIHPRTNSKTFYIAEQVSHHPPISAFYVSNRKDGFCLSGSILAKSKFYGNSLSAILEGEARLTFLNRGEDYVMTMPYAHCKGILYGTMTLELGGTVNITCQKTGYSAILEFKLKPFLGSSDCVNQISGKLKLGKEVLATLEGHWDSEVFITDKKTDNSEVFWNPTPDIKQWRLIRHTVKFEEQGDFESEKLWQRVTRAINAKDQTEATQEKYVLEEAQRQAARDRKTKNEEWSCKLFELDPLTGEWHYKFADTRPWDPLNDMIQFEKDGVIQTKVKHRTPMVSVPKMKHKPTRQQKKVAKGYSSPEPDIQDSSGSEAQSVKPSTRRKKGIELGDIQSSIESIKQTQEEIKRNIMALRNHLVSSTPATDYFLQQKDYFIIFLLILLQVIINFMFK

SEQ ID NO: 56810 - protein, 53 aa, Homo sapiens
MEGGLADGEPDRTSLLGDSKDVLGPSTNSDESQLLTPGKMSQRQGKEAYPTPT

SEQ ID NO: 56811 - protein, 76 aa, Homo sapiens
MSQRQGKEAYPTPTKDLHQPSLSPASPHSQGFERGKEDISQNKDESSLSMSKSKSESKLYNGSEKDSSTSSKLTKK

SEQ ID NO: 56812 - protein, 58 aa, Homo sapiens
MEGGLADGEPDRTSLLGDSKDVLGPSTVVANSDESQLLTPGKMSQRQGKEAYPTPTKD

SEQ ID NO: 56813 - protein, 111 aa, Homo sapiens
MSQRQGKEAYPTPTKDLHQPSLSPASPHSQGFERGKEDISQNKDESSLSMSKSKSESKLYNGSEKDSSTSSKLTKKESLKVQKKNYREEKKRATKELLSTITDPSVIVMAD

SEQ ID NO: 56814 - protein, 741 aa, Homo sapiens
MPYRRVTSGRLLSLAAPKMASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56815 - protein, 626 aa, Homo sapiens
MAFLLATCGGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56816 - protein, 754 aa, Homo sapiens
MPYRRVTSGRLLSLAAPKMASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56817 - protein, 723 aa, Homo sapiens
MASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56818 - protein, 736 aa, Homo sapiens
MASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56819 - protein, 571 aa, Homo sapiens
MVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56820 - protein, 746 aa, Homo sapiens
MASIMEGPLSKWTNVMKGWQYRWFVLDYNAGLLSYYTSKDKMMRGSRRGCVRLRGAVIGIDDEDDSTFTITVDQKTFHFQARDADEREKWIHALEETILRHTLQLQISTTLAFFQSSGISPVLEFSKIIGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56821 - protein, 719 aa, Homo sapiens
MASIMEGPLSKWTNVMKGWQYRWFVLDYNAGLLSYYTGAVIGIDDEDDSTFTITVDQKTFHFQARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKDQSNAEKHADGMISTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56822 - protein, 558 aa, Homo sapiens
MVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56823 - protein, 32 aa, Homo sapiens
MVESIKHCIVLLQIAKDQSNAEKHADGMIVSL

SEQ ID NO: 56824 - protein, 558 aa, Homo sapiens; identical to SEQ ID NO: 56822

SEQ ID NO: 56825 - protein, 655 aa, Homo sapiens
MGCCCCWLVFTEARDADEREKWIHALEETILRHTLQLQGLDSGFVPSVQDFDKKLTEADAYLQILIEQLKLFDDKLQNCKEDEQRKKIETLKETTNSMVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFSYSSSEDEFYDADEFHQSGSSPKRLIDSSGSASVLTHSSSGNSLKRPDTTESLNSSLSNGTSDADLFDSHDDRDDDAEAGSVEEHKSVIMHLLSQVRLGMDLTKVVLPTFILERRSLLEMYADFFAHPDLFVSISDQKDPKDRMVQVVKWYLSAFHAGRKGSVAKKPYNPILGEIFQCHWTLPNDTEENTELVSEGPVPWVSKNSVTFVAEQVSHHPPISAFYAECFNKKIQFNAHIWTKSKFLGMSIGVHNIGQGCVSCLDYDEHYILTFPNGYGRSILTVPWVELGGECNINCSKTGYSANIIFHTKPFYGGKKHRITAEIFSPNDKKSFCSIEGEWNGVMYAKYATGENTVFVDTKKLPIIKKKVRKLEDQNEYESRSLWKDVTFNLKIRDIDAATEAKHRLEERQRAEARERKEKEIQWETRLFHEDGECWVYDEPLLKRLGAAKH

SEQ ID NO: 56826 - protein, 109 aa, Homo sapiens
MVESIKHCIVLLQIAKSTINPVDAIYQPSPLEPVISTMPSQTVLPPEPVQLCKSEQRPSSLPVGPVLATLGHHQTPTPNSTGSGHSPPSSSLTSPSHVNLSPNTVPEFS

SEQ ID NO: 56827 - protein, 389 aa, Homo sapiens
MEGALAANWSAEAANASAAPPGAEGNRTAGPPRRNEALARVEVAVLCLILLLALSGNACVLLALRTTRQKHSRLFFFMKHLSIADLVVAVFQVLPQLLWDITFRFYGPDLLCRLVKYLQVVGMFASTYLLLLMSLDRCLAICQPLRSLRRRTDRLAVLATWLGCLVASAPQVHIFSLREVADGVFDCWAVFIQPWGPKAYITWITLAVYIVPVIVLAACYGLISFKIWQNLRLKTAAAAAAEAPEGAAAGDGGRVALARVSSVKLISKAKIRTVKMTFIIVLAFIVCWTPFFFVQMWSVWDANAPKEASAFIIVMLLASLNSCCNPWIYMLFTGHLFHELVQRFLCCSASYLKGRRLGETSASKKSNSSSFVLSHRSSSQRSCSQPSTA

SEQ ID NO: 56828 - protein, 43 aa, Homo sapiens
MEGALAANWSAEAANASAAPPGAEGNRTAGPPRRNEALARVEV

SEQ ID NO: 56829 - protein, 92 aa, Homo sapiens
MEGALAANWSAEAANASAAPPGAEGNRTAGPPRRNEALARVEVAVLCLILLLALSGNACVLLALRTTRQKHSRLFFFMKHLSIADLVVAVFQ

SEQ ID NO: 56830 - protein, 125 aa, Homo sapiens
MAGPSLACCLLGLLALTSACYIQNCPLGGKRAAPDLDVRKCLPCGPGGKGRCFGPNICCAEELGCFVGTAEALRCQEENYLPSPCQSGQKACGSGGRCAVLGLCCSPDGCHADPACDAEATFSQR

SEQ ID NO: 56831 - protein, 146 aa, Homo sapiens
MGFLRRLIYRRRPMIYVESSEESSDEQPDEVESPTQSQDSTPAEEREDEGASAAQGQEPEADSQELVQPKTGCELGDGPDTKRVCLRNEEQMKLPAEGPEPEADSQEQVHPKTGCERGDGPDVQELGLPNPEEVKTPEEDEGQSQP

SEQ ID NO: 56832 - protein, 111 aa, Homo sapiens
MSELLRARSQSSERGNDQESSQPVGSVIVQEPTEEKRQEEEPPTDNQGIAPSGEIENQAVPAFQGPDMEAFQQELALLKIEDEPGDGPDVREGIMPTFDLTKVLEAGDAQP

SEQ ID NO: 56833 - protein, 64 aa, Homo sapiens
MSELLRARSQSSERGNDQESSQPVGSVIVQEPTEEKRQEEEPPTDNQGIAPSGEIENQAVPAFQ

SEQ ID NO: 56834 - protein, 113 aa, Homo sapiens
MSGHQRTRSRSRERRDDQDSNHPVGAVVAQELPSNDQLQQEEPPIESQDYTPGQERDEGALDFQVLGLAAYLWELTRSKTGGERGDGPNVKGEFLPNLEPVKIPEAGEGQPSV

SEQ ID NO: 56835 - protein, 113 aa, Homo sapiens; identical to SEQ ID NO: 56834

SEQ ID NO: 56836 - protein, 102 aa, Homo sapiens
MSARVRSRSRGRGDGQEAPDVVAFVAPGESQQEEPPTDNQDIEPGQEREGTPPIEERKVEGDCQEMDLEKTRSERGDGSDVKEKTPPNPKHAKTKEAGDGQP

SEQ ID NO: 56837 - protein, 102 aa, Homo sapiens; identical to SEQ ID NO: 56836

SEQ ID NO: 56838 - protein, 524 aa, Homo sapiens
MSDNGELEDKPPAPPVRMSSTIFSTGGKDPLSANHSLKPLPSVPEEKKPRHKIISIFSGTEKGSKKKEKERPEISPPSDFEHTIHVGFDAVTGEFTGMPEQWARLLQTSNITKLEQKKNPQAVLDVLKFYDSNTVKQKYLSFTPPEKDGFPSGTPALNAKGTEAPAVVTEEEDDDEETAPPVIAPRPDHTKSIYTRSVIDPVPAPVGDSHVDGAAKSLDKQKKKTKMTDEEIMEKLRTIVSIGDPKKKYTRYEKIGQGASGTVFTATDVALGQEVAIKQINLQKQPKKELIINEILVMKELKNPNIVNFLDSYLVGDELFVVMEYLAGGSLTDVVTETCMDEAQIAAVCRECLQALEFLHANQVIHRDIKSDNVLLGMEGSVKLTDFGFCAQITPEQSKRSTMVGTPYWMAPEVVTRKAYGPKVDIWSLGIMAIEMVEGEPPYLNENPLRALYLIATNGTPELQNPEKLSPIFRDFLNRCLEMDVEKRGSAKELLQHPFLKLAKPLSSLTPLIMAAKEAMKSNR

SEQ ID NO: 56839 - protein, 559 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTPDLYGSQMCPGKLPEGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 56840 - protein, 580 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTNSPFQTSRPVTVASSQSEGKMPDLYGSQMCPGKLPEGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 56841 - protein, 544 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 56842 - protein, 559 aa, Homo sapiens; identical to SEQ ID NO: 56839

SEQ ID NO: 56843 - protein, 565 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTNSPFQTSRPVTVASSQSEGKMGIPEQWARLLQTSNITKLEQKKNPQAVLDVLKFYDSKETVNNQKYMSFTSGDKSAHGYIAAHPSSTKTASEPPLAPPVSEEEDEEEEEEEDENEPPPVIAPRPEHTKSIYTRSVVESIASPAVPNKEVTPPSAENANSSTLYRNTDRQRKKSKMTDEEILEKLRSIVSVGDPKKKYTRFEKIGQGASGTVYTALDIATGQEVAIKQMNLQQQPKKELIINEILVMRENKNPNIVNYLDSYLVGDELWVVMEYLAGGSLTDVVTETCMDEGQIAAVCRECLQALDFLHSNQVIHRDIKSDNILLGMDGSVKLTDFGFCAQITPEQSKRSTMVGTPYWMAPEVVTRKAYGPKVDIWSLGIMAIEMVEGEPPYLNENPLRALYLIATNGTPELQNPERLSAVFRDFLNRCLEMDVDRRGSAKELLQHPFLKLAKPLSSLTPLIIAAKEAIKNSSR

SEQ ID NO: 56844 - protein, 544 aa, Homo sapiens; identical to SEQ ID NO: 56841

SEQ ID NO: 56845 - protein, 181 aa, Homo sapiens
MSDGLDNEEKPPAPPLRMNSNNRDSSALNHSSKPLPMAPEEKNKKARLRSIFPGGGDKTNKKKEKERPEISLPSDFEHTIHVGFDAVTGEFTNSPFQTSRPVTVASSQSEGKMPDLYGSQMCPGKLPEGIPEQWARLLQTSNITKLEQKKNPQAVLDVLKFYDSKETVNNQKYMSFTSGDK

SEQ ID NO: 56846 - protein, 544 aa, Homo sapiens; identical to SEQ ID NO: 56841

SEQ ID NO: 56847 - protein, 580 aa, Homo sapiens; identical to SEQ ID NO: 56840

SEQ ID NO: 56848 - protein, 565 aa, Homo sapiens; identical to SEQ ID NO: 56843

SEQ ID NO: 56849 - protein, 681 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQSKPNSSFRPPQKDNPPSLVAKAQSLPSDQPVGTFSPLTTSDTSSPQKSLRTAPATGQLPGRSSPAGSPRTWHAQISTSNLYLPQDPTVAKGALAGEDTGVVTHEQFKAALRMVVDQGDPRLLLDSYVKIGEGSTGIVCLAREKHSGRQVAVKMMDLRKQQRRELLFNEVVIMRDYQHFNVVEMYKSYLVGEELWVLMEFLQGGALTDIVSQVRLNEEQIATVCEAVLQALAYLHAQGVIHRDIKSDSILLTLDGRVKLSDFGFCAQISKDVPKRKSLVGTPYWMAPEVISRSLYATEVDIWSLGIMVIEMVDGEPPYFSDSPVQAMKRLRDSPPPKLKNSHKVSPVLRDFLERMLVRDPQERATAQELLDHPFLLQTGLPECLVPLIQLYRKQTSTC

SEQ ID NO: 56850 - protein, 681 aa, Homo sapiens; identical to SEQ ID NO: 56849

SEQ ID NO: 56851 - protein, 681 aa, Homo sapiens; identical to SEQ ID NO: 56849

SEQ ID NO: 56852 - protein, 122 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHW

SEQ ID NO: 56853 - protein, 123 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWA

SEQ ID NO: 56854 - protein, 109 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRR

SEQ ID NO: 56855 - protein, 112 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQ

SEQ ID NO: 56856 - protein, 681 aa, Homo sapiens; identical to SEQ ID NO: 56849

SEQ ID NO: 56857 - protein, 284 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSPTSRRRAQSLGLLGDEHWATDPDMYLQSPQSERTDPHGLYLSCNGGTPAGHKQMPWPEPQSPRVLPNGLAAKAQSLGPAEFQGASQRCLQLGACLQSSPPGASPPTGTNRHGMKAAKHGSEEARPQSCLVGSATGRPGGEGSPSPKTRESSLKRRLFRSMFLSTAATAPPSSSKPGPPPQ

SEQ ID NO: 56858 - protein, 105 aa, Homo sapiens
MFRKKKKKRPEISAPQNFQHRVHTSFDPKEGKFVGLPPQWQNILDTLRRPKPVVDPSRITRVQLQPMKTVVRGSAMPVDGYISGLLNDIQKLSVISSNTLRGRSP

SEQ ID NO: 56859 - protein, 146 aa, Homo sapiens
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEG

SEQ ID NO: 56860 - protein, 172 aa, Homo sapiens
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFA

SEQ ID NO: 56861 - protein, 62 aa, Homo sapiens
MINMGDSHVDTSSTVSEAVAEEVSLFSMTDMILFSLIVGLLTYWFLFRKKKEEVPEFTKIQT

SEQ ID NO: 56862 - protein, 368 aa, Homo sapiens
MGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALAVPTSTSVGMHGTWPGMCRTPSTTSWLSSGPWSTRRRWTTSRN

SEQ ID NO: 56863 - protein, 39 aa, Homo sapiens
MINMGDSHVDTSSTVSEAVAEEVSLFSMTDMILFSLIVG

SEQ ID NO: 56864 - protein, 166 aa, Homo sapiens
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDL

SEQ ID NO: 56865 - protein, 188 aa, Homo sapiens
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMG

SEQ ID NO: 56866 - protein, 62 aa, Homo sapiens; identical to SEQ ID NO: 56861

SEQ ID NO: 56867 - protein, 573 aa, Homo sapiens
MGSRWPAVPPWGLQIHVSERQPSRPPPCPQQPGQATCETLSSAPDPSTTRMSPPCPQPQSAPGGIGCWRLKVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGTPSSCPGMHGTWPGMCRTPSTTSWLSSGPWSTRRRWTTSRN

SEQ ID NO: 56868 - protein, 140 aa, Homo sapiens
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCM

SEQ ID NO: 56869 - protein, 680 aa, Homo sapiens
MINMGDSHVDTSSTVSEAVAEEVSLFSMTDMILFSLIVGLLTYWFLFRKKKEEVPEFTKIQTLTSSVRESSFVEKMKKTGRNIIVFYGSQTGTAEEFANRLSKDAHRYGMRGMSADPEEYDLADLSSLPEIDNALVVFCMATYGEGDPTDNAQDFYDWLQETDVDLSGVKFAVFGLGNKTYEHFNAMGKYVDKRLEQLGAQRIFELGLGDDDGNLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 56870 - protein, 488 aa, Homo sapiens
MPRTSTTGCRRQTWISLGSSSRLEEDFITWREQFWPAVCEHFGVEATGEESSIRQYELVVHTDIDAAKVYMGEMGRLKSYENQKPPFDAKNPFLAAVTTNRKLNQGTERHLMHLELDISDSKIRYESGDHVAVYPANDSALVNQLGKILGADLDVVMSLNNLDEESNKKHPFPCPTSYRTALTYYLDITNPPRTNVLYELAQYASEPSEQELLRKMASSSGEGKELYLSWVVEARRHILAILQDCPSLRPPIDHLCELLPRLQARYYSIASSSKVHPNSVHICAVVVEYETKAGRINKGVATNWLRAKEPAGENGGRALVPMFVRKSQFRLPFKATTPVIMVGPGTGVAPFIGFIQERAWLRQQGKEVGETLLYYGCRRSDEDYLYREELAQFHRDGALTQLNVAFSREQSHKVYVQHLLKQDREHLWKLIEGGAHIYVCGDARNMARDVQNTFYDIVAELGAMEHAQAVDYIKKLMTKGRYSLDVWS

SEQ ID NO: 56871 - protein, 133 aa, Homo sapiens
MLSPEAERVLRYLVEVEELAEEVLADKRQIVDLDTKRNQNREGLRALQKDLSLSEDVMVCFGNMFIKMPHPETKEMIEKDQDHLDKEIEKLRKQLKVKVNRLFEAQGKPELKGFNLNPLNQDELKALKVILKG

SEQ ID NO: 56872 - protein, 534 aa, Homo sapiens
MKFTLGLGSRAWRVSWEGAAAAAAGPGAGGSALRCRAQRVSSPRLGRRGSRLSGALPLCLSRGGGGAQALPDCAGPSPGHPGHPGARQLAGPLAMEQTYGEVNQLGGVFVNGRPLPNAIRLRIVELAQLGIRPCDISRQLRVSHGCVSKILARYNETGSILPGAIGGSKPRVTTPNVVKHIRDYKQGDPGIFAWEIRDRLLADGVCDKYNVPSVSSISRILRNKIGSLAQPGPYEASKQPPSQPTLPYNHIYQYPYPSPVSPTGAKMGSHPGVPGTAGHVSIPRSWPSAHSVSNILGIRTFMEQTGALAGSEGTAYSPKMEDWAGVNRTAFPATPAVNGLEKPALEADIKYTQSASTLSAVGGFLPACAYPASNQHGVYSAPGGGYLAPGPPWPPAQGPPLAPPGAGVAVHGGELAAAMTFKHPSREGSLPAPAARPRTPSVAYTDCPSRPRPPRGSSPRTRARRERQADPGAQVCAAAPAIGTGRIGGLAEEEASAGPRGARPASPQAQPCLWPDPPHFLYWSGFLGFSELGF

SEQ ID NO: 56873 - protein, 394 aa, Homo sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 56874 - protein, 396 aa, Homo sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPEAAVGPSSSLMSKPGRKLAEVPPCVQPTGASSPATRTATPSTRPTTRLGDSATPPY

SEQ ID NO: 56875 - protein, 329 aa, Homo sapiens
MFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSLPLLPLPMTATSYRGDHIKLQADSFGLHIVPV

SEQ ID NO: 56876 - protein, 419 aa, Homo sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPEAAVGPSSSLMSKPGRKLAEVPPCVQPTGASSPATRTATPSTRPTTRLGDSATPPY

SEQ ID NO: 56877 - protein, 214 aa, Homo sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAH

SEQ ID NO: 56878 - protein, 417 aa, Homo sapiens
MDMHCKADPFSAMHPGHGGVNQLGGVFVNGRPLPDVVRQRIVELAHQGVRPCDISRQLRVSHGCVSKILGRYYETGSIKPGVIGGSKPKVATPKVVDKIAEYKRQNPTMFAWEIRDRLLAEGICDNDTVPSVSSINRIIRTKVQQPFHPTPDGAGTGVTAPGHTIVPSTASPPVSSASNDPVGSYSINGILGIPRSNGEKRKRDEVEVYTDPAHIRGGGGLHLVWTLRDVSEGSVPNGDSQSGVDSLRKHLRADTFTQQQLEALDRVFERPSYPDVFQASEHIKSEQGNEYSLPALTPGLDEVKSSLSASTNPELGSNVSGTQTYPVVTGRDMASTTLPGYPPHVPPTGQGSYPTSTLAGMVPGSEFSGNPYSHPQYTAYNEAWRFSNPALLSSPYYYSAAPRGSAPAAAAAAYDRH

SEQ ID NO: 56879 - protein, 206 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKALVSGVSSH

SEQ ID NO: 56880 - protein, 407 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISLGFKSF

SEQ ID NO: 56881 - protein, 403 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVPFIISSQISRK

SEQ ID NO: 56882 - protein, 479 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSKPWTF

SEQ ID NO: 56883 - protein, 505 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIAWFQILLNTFDKSSGEEEDLEQ

SEQ ID NO: 56884 - protein, 484 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 56885 - protein, 483 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKVTTPDVEKKIEEYKRENPGMFSWEIRDKLLKDAVCDRNTVPSVSSISRILRSKFGKGEEEEADLERKEAEESEKKAKHSIDGILSERASAPQSDEGSDIDSEPDLPLKRKQRRSRTTFTAEQLEELERAFERTHYPDIYTREELAQRAKLTEARVQVWFSNRRARWRKQAGANQLMAFNHLIPGGFPPTAMPTLPTYQLSETSYQPTSIPQAVSDPSSTVHRPQPLPPSTVHQSTIPSNPDSSSAYCLPSTRHGFSSYTDSFVPPSGPSNPMNPTIGNGLSPQVMGLLTNHGGVPHQPQTDYALSPLTGGLEPTTTVSASCSQRLDHMKSLDSLPTSQSYCPPTYSTTGYSMDPVTGYQYGQYGQSAFHYLKPDIA

SEQ ID NO: 56886 - protein, 215 aa, Homo sapiens
MTTLAGAVPRMMRPGPGQNYPRSGFPLEVSTPLGQGRVNQLGGVFINGRPLPNHIRHKIVEMAHHGIRPCVISRQLRVSHGCVSKILCRYQETGSIRPGAIGGSKPKQVTTPDVEKKIEEYKRENPGMFSWEIRDKLLKDAVCDRNTVPSVSSISRILRSKFGKGEEEEADLERKEAEESEKKAKHSIDGILSERGKRWRLGRRTCWVTWRASAS

SEQ ID NO: 56887 - protein, 273 aa, Homo sapiens
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPAVPWQCAHSSPACPGTTGSLLLSAVLGNSTRKVSE

SEQ ID NO: 56888 - protein, 343 aa, Homo sapiens
MNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWGHLPPQPNSLDSGLLCLPCPSSHCHLASLSGSQALLWPGCPLLYGLE

SEQ ID NO: 56889 - protein, 348 aa, Homo sapiens
MHQDGISSMNQLGGLFVNGRPLPLDTRQQIVRLAVSGMRPCDISRILKVSNGCVSKILGRYYRTGVLEPKGIGGSKPRLATPPVVARIAQLKGECPALFAWEIQRQLCAEGLCTQDKTPSVSSINRVLRALQEDQGLPCTRLRSPAVLAPAVLTPHSGSETPRGTHPGTGHRNRTIFSPSQAEALEKEFQRGQYPDSVARGKLATATSLPEDTVRVWFSNRRAKWRRQEKLKWEMQLPGASQGLTVPRVAPGIISAQQSPGSVPTAALPALEPLGPSCYQLCWATAPERCLSDTPPKACLKPCWDCGSFLLPVIAPSCVDVAWPCLDASLAHHLIGGAGKATPTHFSH

SEQ ID NO: 56890 - protein, 520 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 56891 - protein, 518 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQSECLVPWASPVPIPSPTPRASCLFMESYKVVSGWGMSISQMEKLKSSQMEQFT

SEQ ID NO: 56892 - protein, 505 aa, Homo sapiens
MAALPGTVPRMMRPAPGQNYPRTGFPLEVSTPLGQGRVNQLGGVFINGRPLPNHIRHKIVEMAHHGIRPCVISRQLRVSHGCVSKILCRYQETGSIRPGAIGGSKPRQVATPDVEKKIEEYKRENPGMFSWEIRDRLLKDGHCDRSTVPSGLVSSISRVLRIKFGKKEEEDEADKKEDDGEKKAKHSIDGILGDKGNRLDEGSDVESEPDLPLKRKQRRSRTTFTAEQLEELEKAFERTHYPDIYTREELAQRTKLTEARVQVWFSNRRARWRKQAGANQLAAFNHLLPGGFPPTGMPTLPPYQLPDSTYPTTTISQDGGSTVHRPQPLPPSTMHQGGLAAAAAAADTSSAYGARHSFSSYSDSFMNPAAPSNHMNPVSNGLSPQVMSILGNPSAVPPQPQADFSISPLHGGLDSATSISASCSQRADSIKPGDSLPTSQAYCPPTYSTTGYSVDPVAGYQYGQYGQTAVDYLAKNVSLSTQRRMKLGEHSAVLGLLPVETGQAY

SEQ ID NO: 56893 - protein, 341 aa, Homo sapiens
MEPAFGEVNQLGGVFVNGRPLPNAIRLRIVELAQLGIRPCDISRQLRVSHGCVSKILARYNETGSILPGAIGGSKPRVTTPTVVKHIRTYKQRDPGIFAWEIRDRLLADGVCDKYNVPSVSSISRILRNKIGNLAQQGHYDSYKQHQPTPQPALPYNHIYSYPSPITAAAAKVPTPPGVPAIPGSVAMPRTWPSSHSVTDILGIRSITDQVSDSSPYHSPKVEEWSSLGRNNFPAAAPHAVNGLEKGALEQEAKYGQAPNGLPAVGSFVSASSMAPYPTPAQVSPYMTYSAAPSGYVAGHGWQHAGGTSLSPHNCDIPASLAFKGMQAAREGSHSVTASAL

SEQ ID NO: 56894 - protein, 341 aa, Homo sapiens; identical to SEQ ID NO: 56893

SEQ ID NO: 56895 - protein, 60 aa, Homo sapiens
SDSSPYHSPKVEEWSSLGRNNFPAAAPHAVNGLEKGALEQEAKYGQIQNFFLLMISRLKF

SEQ ID NO: 56896 - protein, 303 aa, Homo sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQAVTTTTQRPSSMTTTWRLSSTTTTTGLRVTQGKRRSDSWHISLETAVGVAVAVTVLGIMILGLICLLRWRRRKGQQRTKATTPAREPFQNTEEPYENIRNEGQNTDPKLNPKDDGIVYASLALSSSTSPRAPPSHRPLKSPQNETLYSVLKA

SEQ ID NO: 56897 - protein, 230 aa, Homo sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAREPFQNTEEPYENIRNEGQNTDPKLNPKDDGIVYASLALSSSTSPRAPPSHRPLKSPQNETLYSVLKA

SEQ ID NO: 56898 - protein, 175 aa, Homo sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGNPSKTQRSHMRISGMKDKIQIPS

SEQ ID NO: 56899 - protein, 163 aa, Homo sapiens
MGRPLLLPLLPLLLPPAFLQPSGSTGSGPSYLYGVTQPKHLSASMGGSVEIPFSFYYPWELATAPDVRISWRRGHFHRQSFYSTRPPSIHKDYVNRLFLNWTEGQKSGFLRISNLQKQDQSVYFCRVELDTRSSGRQQWQSIEGTKLSITQGQQRTKATTPAR

SEQ ID NO: 56900 - protein, 227 aa, Homo sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLLWWRRRKGSRAPSSDF

SEQ ID NO: 56901 - protein, 332 aa, Homo sapiens
MGRASYGGSPVGHQSSSDHPRAKTCRSPVRDGPRTLCGVPTVALSLHFLREASSGSRTCGRRTSLCTSAKSSWTYRSALRQPLHRAPLLPGQLCWSPRPLEKNKAMGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLLWWRRRKGSRAPSSDF

SEQ ID NO: 56902 - protein, 127 aa, Homo sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRV

SEQ ID NO: 56903 - protein, 227 aa, Homo sapiens; identical to SEQ ID NO: 56900

SEQ ID NO: 56904 - protein, 127 aa, Homo sapiens; identical to SEQ ID NO: 56902

SEQ ID NO: 56905 - protein, 60 aa, Homo sapiens
MGRPLLLPLLLLLQPPAFLQPGLCEPALSELDRGSGERLPQDLKPAEGGPVCVFLPSRAG

SEQ ID NO: 56906 - protein, 121 aa, Homo sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQS

SEQ ID NO: 56907 - protein, 127 aa, Homo sapiens; identical to SEQ ID NO: 56902

SEQ ID NO: 56908 - protein, 227 aa, Homo sapiens; identical to SEQ ID NO: 56900

SEQ ID NO: 56909 - protein, 149 aa, Homo sapiens
MGRPLLLPLLLLLQPPAFLQPGLCEPALSELDRGSGERLPQDLKPAEGGPVCVFLPSRAGHPEIREAAVAVHQGDQTHHHPGCHNHHHLEAQQHNHHSRPQGHRKQRALRIMAPKSGHCHQGCIGCRCAQNCHFGTAVPPPPVVEEKER

SEQ ID NO: 56910 - protein, 271 aa, Homo sapiens
MGRASYGGSPVGHQSSSDHPRAKTCRSPVRDGPRTLCGVPTVALSLHFLREASSGSRTCGRRTSLCTSAKSSWTYRSGRLSWQSIKGTHLTITQALRQPLHRAPLLPGQLCWSPRPLEKNKAMGRPLLLPLLLLLQPPAFLQPGLCEPALSELDRGSGERLPQDLKPAEGGPVCVFLPSRAGHPEIREAAVAVHQGDQTHHHPGCHNHHHLEAQQHNHHSRPQGHRKQRALRIMAPKSGHCHQGCIGCRCAQNCHFGTAVPPPPVVEEKER

SEQ ID NO: 56911 - protein, 227 aa, Homo sapiens; identical to SEQ ID NO: 56900

SEQ ID NO: 56912 - protein, 108 aa, Homo sapiens
MGRASYGGSPVGHQSSSDHPRAKTCRSPVRDGPRTLCGVPTVALSLHFLREASSGSRTCGRRTSLCTSAKSSWTYRSGRLSWQSIKGTHLTITQALRQPLHRAPLLPG

SEQ ID NO: 56913 - protein, 127 aa, Homo sapiens; identical to SEQ ID NO: 56902

SEQ ID NO: 56914 - protein, 245 aa, Homo sapiens
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYSAMATYSATCANNSPAQGINMANSIANLRLKAKEYSLQRNQVPTVN

SEQ ID NO: 56915 - protein, 217 aa, Homo sapiens
MTSSYGHVLERQPALGGRLDSPGNLDTLQAKKNFSVSHLLDLEEAGDMVAAQADENVGEAGRSLLESPGLTSGSDTPQQDNDQLNSEEKKKRKQRRNRTTFNSSQLQALERVFERTHYPDAFVREDLARRVNLTEARVQVWFQNRRAKFRRNERAMLANKNASLLKSYSGDVTAVEQPIVPRPAPRPTDYLSWGTASPYRSSSLPRCCLHEGLHNGF

SEQ ID NO: 56916 - protein, 253 aa, Homo sapiens
MDSAAAAFALDKPALGPGPPPPPPALGPGDCAQARKNFSVSHLLDLEEVAAAGRLAARPGARAEAREGAAREPSGGSSGSEAAPQDGECPSPGRGSAAKRKKKQRRNRTTFNSSQLQALERVFERTHYPDAFVREELARRVNLSEARVQVWFQNRRAKFRRNERAMLASRSASLLKSYSQEAAIEQPVAPRPTALSPDYLSWTASSPYSTVPPYSPGSSGPATPGVNMANSIASLRLKAKEFSLHHSQVPTVN

SEQ ID NO: 56917 - protein, 284 aa, Homo sapiens
MDYSYLNSYDSCVAAMEASAYGDFGACSQPGGFQYSPLRPAFPAAGPPCPALGSSNCALGALRDHQPAPYSAVPYKFFPEPSGLHEKRKQRRIRTTFTSAQLKELERVFAETHYPDIYTREELALKIDLTEARVQVWFQNRRAKFRKQERAASAKGAAGAAGAKKGEARCSSEDDDSKESTCSPTPDSTASLPPPPAPGLASPRLSPSPLPVALGSGPGPGPGPQPLKGALWAGVAGGGGGGPGAGAAELLKAWQPAESGPGPFSGVLSSFHRKPGPALKTNLF

SEQ ID NO: 56918 - protein, 314 aa, Homo sapiens
MYKMEYSYLNSSAYESCMAGMDTSSLASAYADFSSCSQASGFQYNPIRTTFGATSGCPSLTPGSCSLGTLRDHQSSPYAAVPYKLFTDHGGLNEKRKQRRIRTTFTSAQLKELERVFAETHYPDIYTREELALKIDLTEARVQVWFQNRRAKFRKQERAAAAAAAAAKNGSSGKKSDSSRDDESKEAKSTDPDSTGGPGPNPNPTPSCGANGGGGGGPSPAGAPGAAGPGGPGGEPGKGGAAAAAAAAAAAAAAAAAAAAGGLAAAGGPGQGWAPGPGPITSIPDSLGGPFASVLSSLQRPNGAKAALVKSSMF

SEQ ID NO: 56919 - protein, 314 aa, Homo sapiens
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYPDMSMREEIAVWTNLTEPRVRVWFKNRRAKWRKRERNQQLDLCKGGYVPQFSGLVQPYEDVYAAGYSYNNWAAKSLAPAPLSTKSFTFFNSMSPLSSQSMFSAPSSISSMTMPSSMGPGAVPGMPNSGLNNINNLTGSSLNSAMSPGACPYGTPASPYSVYRDTCNSSLASLRLKSKQHSSFGYGGLQGPASGLNACQYNS

SEQ ID NO: 56920 - protein, 114 aa, Homo sapiens
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYP

SEQ ID NO: 56921 - protein, 314 aa, Homo sapiens; identical to SEQ ID NO: 56919

SEQ ID NO: 56922 - protein, 131 aa, Homo sapiens
MDAFKGGMSLERLPEGLRPPPPPPHDMGPAFHLARPADPREPLENSASESSDTELPEKERGGEPKGPEDSGAGGTGCGGADDPAKKKKQRRQRTHFTSQQLQELEATFQRNRYPDMSMREEIAVWTNLTEP

SEQ ID NO: 56923 - protein, 324 aa, Homo sapiens
MNCMKGPLHLEHRAAGTKLSAVSSSSCHHPQPLAMASVLAPGQPRSLDSSKHRLEVHTISDTSSPEAAEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 56924 - protein, 317 aa, Homo sapiens
METNCRKLVSACVQLGVQPAAVECLFSKDSEIKKVEFTDSPESRKEAASSKFFPRQHPGANEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 56925 - protein, 271 aa, Homo sapiens
METNCRKLVSACVQLEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQHSSFGYASVQNPASNLSACQYAVDRPV

SEQ ID NO: 56926 - protein, 317 aa, Homo sapiens; identical to SEQ ID NO: 56924

SEQ ID NO: 56927 - protein, 290 aa, Homo sapiens
METNCRKLVSACVQLGVQPAAVECLFSKDSEIKKVEFTDSPESRKEAASSKFFPRQHPGANEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLMQPYDDMYPGYSYNNWAAKGLTSASLSTKSFPFFNSMNVNPLSSQSMFSPPNSISSMSMSSSMVPSAVTGVPGSSLNSLNNLNNLSSPSLNSAVPTPACPYAPPTPPYVYRDTCNSSLASLRLKAKQ

SEQ ID NO: 56928 - protein, 118 aa, Homo sapiens
METNCRKLVSACVQLEKDKSQQGKNEDVGAEDPSKKKRQRRQRTHFTSQQLQELEATFQRNRYPDMSTREEIAVWTNLTEARVRVWFKNRRAKWRKRERNQQAELCKNGFGPQFNGLM

SEQ ID NO: 56929 - protein, 302 aa, Homo sapiens
MEFGLLSEAEARSPALSLSDAGTPHPQLPEHGCKGQEHSDSEKASASLPGGSPEDGSLKKKQRRQRTHFTSQQLQELEATFQRNRYPDMSTREEIAVWTNLTEARVRVWFKNRRAKWRKRERSQQAELCKGSFAAPLGGLVPPYEEVYPGYSYGNWPPKALAPPLAAKTFPFAFNSVNVGPLASQPVFSPPSSIAASMVPSAAAAPGTVPGPGALQGLGGGPPGLAPAAVSSGAVSCPYASAAAAAAAAASSPYVYRDPCNSSLASLRLKAKQHASFSYPAVHGPPPAANLSPCQYAVERPV

SEQ ID NO: 56930 - protein, 302 aa, Homo sapiens; identical to SEQ ID NO: 56929

SEQ ID NO: 56931 - protein, 392 aa, Homo sapiens
MELVAGCYEQVLFGFAVHPEPEACGDHEQWTLVADFTHHAHTASLSAVAVNSRFVVTGSKDETIHIYDMKKKIEHGALVHHSGTITCLKFYGNRHLISGAEDGLICIWDAKKWECLKSIKAHKGQVTFLSIHPSGKLALSVGTDKTLRTWNLVEGRSAFIKNIKQNAHIVEWSPRGEQYVVIIQNKIDIYQLDTASISGTITNEKRISSVKFLSESVLAVAGDEEVIRFFDCDSLVCLCEFKAHENRVKDMFSFEIPEHHVIVSASSDGFIKMWKLKQDKKVPPSLLCEINTNARLTCLGVWLDKVADMKESLPPAAEPSPVSKEQSKIGKKEPGDTVHKEEKRSKPNTKKRGLTGDSKKATKESGLISTKKRKMVEMLEKKRKKKKIKTMQ

SEQ ID NO: 56932 - protein, 1123 aa, Homo sapiens
MSGTSSHESFYDSLSDMQEESKNTDFFPGLSAFLSQEEINKSLDLARRAIADSETEDFDSEKEISQIFSTSPASLCEHPSHKETKLGEHASRRPQDNRSTPVQPLAEKQTKSISSPVSKRKPAMSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLGFPKKASRTARIASDEEIQGTKDAVIQDLERKLRFKEDLLNNGQPRLTYEERMARRLLGADSATVFNIQEPEEETANQDIGSPHASVGSPLDGQKEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYISRH

SEQ ID NO: 56933 - protein, 672 aa, Homo sapiens
MSALASRSAPAMQSSGSFNYARPKQFIAAQNLGPASGHGTPASSPSSSSLPSPMSPTPRQFGRAPVPPFAQPFGAEPEAPWGSSSPSPPPPPPPVFSPTAAFPVPDVFPLPPPPPPLPSPGQASHCSSPATRFGHSQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 56934 - protein, 777 aa, Homo sapiens
MPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 56935 - protein, 1106 aa, Homo sapiens
MSGTSSHESFYDSLSDMQEESKNTDFFPGLSAFLSQEEINKSLDLARRAIADSETEDFDSEKEISQIFSTSPASLCEHPSHKETKLGEHASRRPQDNRSTPVQPLAEKQTKSISSPVSKRKPAMSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYISRH

SEQ ID NO: 56936 - protein, 410 aa, Homo sapiens
MSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPDVLYVFVRVRCHQMKIQYYNLAHLISSWLSSFL

SEQ ID NO: 56937 - protein, 1001 aa, Homo sapiens
MPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPEEICTLVIAETFPEDAGIFTCSARNDYGSATSTAQLVVTSANTENCSYESMGESNNDHFQHFPPPPPILETSSLELASKKPSEIQQVNNPELGLSRAALQMQFNAAERETNGVHPSRGVNGLINGKANSNKSLPTPAVLLSPTKEPPPLLAKPKLDPLKLQQLQNQIRLEQEAGARQPPPAPRSAPPSPPFPPPPAFPELAACTPPASPEPMSALASRSAPAMQSSGSFNYARPKQFIAAQNLGPASGHGTPASSPSSSSLPSPMSPTPRQFGRAPVPPFAQPFGAEPEAPWGSSSPSPPPPPPPVFSPTAAFPVPDVFPLPPPPPPLPSPGQASHCSSPATRFGHSQTPAAFLSALLPSQPPPAAVNALGLPKGVTPAGFPKKASRTARIASDEEIQGTKDAVIQDLERKLRFKEDLLNNGQPRLTYEERMARRLLGADSATVFNIQEPEEETANQEYKVSSCEQRLISEIEYRLERSPVDESGDEVQYGDVPVENGMAPFFEMKLKHYKIFEGMPVTFTCRVAGNPKPKIYWFKDGKQISPKSDHYTIQRDLDGTCSLHTTASTLDDDGNYTIMAANPQGRISCTGRLMVQAVNQRGRSPRSPSGHPHVRRPRSRSRDSGDENEPIQERFFRPHFLQAPGDLTVQEGKLCRMDCKVSGLPTPDLSWQLDGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYTQWHQQSQSTKPKKVRPSASRYAALSDQGLDIKAAFQPEANPSHLTLNTALVESEDL

SEQ ID NO: 56938 - protein, 160 aa, Homo sapiens
  MOD_RES (1)..(1): Any amino acid
XGKPVRPDSAHKMLVRENGVHSLIIEPVTSRDAGIYTCIATNRAGQNSFSLELVVAAKEAHKPPVFIEKLQNTGVADGYPVRLECRVLGVPPPQIFWKKENESLTHSTDRVSMHQDNHGYICLLIQGATKEDAGWYTVSAKNEAGIVSCTARLDVYISRH

SEQ ID NO: 56939 - protein, 512 aa, Homo sapiens
KNTDFFPGLSAFLSQEEINKSLDLARRAIADSETEDFDSEKEISQIFSTSPASLCEHPSHKETKLGEHASRRPQDNRSTPVQPLAEKQTKSISSPVSKRKPAMSPLLTRPSYIRSLRKAEKRGAKTPSTNVKPKTPHQRKGGPQSQLCDKAANLIEELTSIFKAAKPRNRSPNGESSSPDSGYLSPKNQPSALLSASASQSPMEDQGEMEREVKSPGARHCYQDNQDLAVPHNRKSHPQPHSALHFPAAPRFIQKLRSQEVAEGSRVYLECRVTGNPTPRVRWFCEGKELHNTPDIQIHCEGGDLHTLIIAEAFEDDTGRYTCLATNPSGSDTTSAEVFIEGASSTDSDSESLAFKSRAGAMPQAQKKTTSVSLTIGSSSPKTGVTTAVIQPLSVPVQQVHSPTSYLCRPDGTTTAYFPPVFTKELQNTAVAEGQVVVLECRVRGAPPLQVQWFRQGSEIQDSPDFRILQKKPRSTAEPDVLYVFVRVRCHQMKIQYYNLAHLISSWLSSFL

SEQ ID NO: 56940 - protein, 28 aa, Homo sapiens
MSGTSSHESFYDSLSDMQEESKNTDFFP

SEQ ID NO: 56941 - protein, 172 aa, Homo sapiens
MSVPGPSSPDGALTRPPYCLEAGEPTPGLSDTSPDEGLIEDLTIEDKAVEQLAEGLLSHYLPDLQRSKQALQELTQNQVVLLDTLEQEISKFKECHSMLDINALFAEAKHYHAKLVNIRKEMLMLHEKTSKLKKRALKLQQKRQKEELEREQQREKEFEREKQLTARPAKRM

SEQ ID NO: 56942 - protein, 271 aa, Homo sapiens
MASPGCLWLLAVALLPWTCASRALQHLDPPAPLPLVIWHGMGSRYVAQTGLELLASSNPPASSYQSAGMIGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSE

SEQ ID NO: 56943 - protein, 306 aa, Homo sapiens
MASPGCLWLLAVALLPWTCASRALQHLDPPAPLPLVIWHGMGDSCCNPLSMGAIKKMVEKKIPGIYVLSLEIGKTLMEDVENSFFLNVNSQVTTVCQALAKDPKLQQGYNAMGFSQGGQFLRAVAQRCPSPPMINLISVGGQHQGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 56944 - protein, 203 aa, Homo sapiens
MASPGCLWLLAVALLPWTCASRALQHLDPPAPLPLVIWHGMGVFGLPRCPGESSHICDFIRKTLNAGAYSKVVQERLVQAEYWHDPIKEDVYRNHSIFLADINQERGINESYKKNLMALKKFVMVKFLNDSIVDPVDSEWFGFYRSGQAKETIPLQETSLYTQDRLGLKEMDNAGQLVFLATEGDHLQLSEEWFYAHIIPFLG

SEQ ID NO: 56945 - protein, 306 aa, Homo sapiens; identical to SEQ ID NO: 56943

SEQ ID NO: 56946 - protein, 302 aa, Homo sapiens
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 56947 - protein, 308 aa, Homo sapiens
MKSCGSMLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 56948 - protein, 302 aa, Homo sapiens; identical to SEQ ID NO: 56946

SEQ ID NO: 56949 - protein, 302 aa, Homo sapiens; identical to SEQ ID NO: 56946

SEQ ID NO: 56950 - protein, 308 aa, Homo sapiens
MKSCGSMLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 56951 - protein, 308 aa, Homo sapiens
MKSCGSMLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 56952 - protein, 302 aa, Homo sapiens; identical to SEQ ID NO: 56946

SEQ ID NO: 56953 - protein, 302 aa, Homo sapiens
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 56954 - protein, 302 aa, Homo sapiens; identical to SEQ ID NO: 56953

SEQ ID NO: 56955 - protein, 302 aa, Homo sapiens; identical to SEQ ID NO: 56953

SEQ ID NO: 56956 - protein, 302 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLVYLRDSFGLKTLLARGAIVRCPMAGISHTAWHSNRTLYETCIEPWLS

SEQ ID NO: 56957 - protein, 302 aa, Homo sapiens; identical to SEQ ID NO: 56956

SEQ ID NO: 56958 - protein, 302 aa, Homo sapiens; identical to SEQ ID NO: 56956

SEQ ID NO: 56959 - protein, 308 aa, Homo sapiens; identical to SEQ ID NO: 56951

SEQ ID NO: 56960 - protein, 93 aa, Homo sapiens
MLGLWGQRLPAAWVLLLLPFLPLLLLAAPAPHRASYKPVIVVHGLFDSSYSFRHLLEYINEGALCAGLCFLSWMITTWILSSPSPLHRWDSME

SEQ ID NO: 56961 - protein, 180 aa, Homo sapiens
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWH

SEQ ID NO: 56962 - protein, 308 aa, Homo sapiens; identical to SEQ ID NO: 56951

SEQ ID NO: 56963 - protein, 200 aa, Homo sapiens
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALING

SEQ ID NO: 56964 - protein, 158 aa, Homo sapiens
MLGLWGQRLPAAWVLLLLPFLPLLLLAAPAPHRESYKPVIVVHGLFDSSYSFRHLLEYINEMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 56965 - protein, 180 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWH

SEQ ID NO: 56966 - protein, 158 aa, Homo sapiens
MLGLWGQRLPAAWVLLLLPFLPLLLLAAPAPHRASYKPVIVVHGLFDSSYSFRHLLEYINEMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 56967 - protein, 180 aa, Homo sapiens; identical to SEQ ID NO: 56965

SEQ ID NO: 56968 - protein, 302 aa, Homo sapiens; identical to SEQ ID NO: 56956

SEQ ID NO: 56969 - protein, 302 aa, Homo sapiens; identical to SEQ ID NO: 56956

SEQ ID NO: 56970 - protein, 308 aa, Homo sapiens; identical to SEQ ID NO: 56951

SEQ ID NO: 56971 - protein, 93 aa, Homo sapiens; identical to SEQ ID NO: 56960

SEQ ID NO: 56972 - protein, 302 aa, Homo sapiens; identical to SEQ ID NO: 56956

SEQ ID NO: 56973 - protein, 158 aa, Homo sapiens
MLGLCGQRLPAAWVLLLLPFLPLLLLAAPAPHRASYKPVIVVHGLFDSSYSFRHLLEYINEMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 56974 - protein, 236 aa, Homo sapiens
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 56975 - protein, 180 aa, Homo sapiens; identical to SEQ ID NO: 56965

SEQ ID NO: 56976 - protein, 236 aa, Homo sapiens; identical to SEQ ID NO: 56974

SEQ ID NO: 56977 - protein, 200 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALING

SEQ ID NO: 56978 - protein, 302 aa, Homo sapiens; identical to SEQ ID NO: 56956

SEQ ID NO: 56979 - protein, 200 aa, Homo sapiens; identical to SEQ ID NO: 56977

SEQ ID NO: 56980 - protein, 242 aa, Homo sapiens
MKSCGSMLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQS

SEQ ID NO: 56981 - protein, 236 aa, Homo sapiens; identical to SEQ ID NO: 56974

SEQ ID NO: 56982 - protein, 180 aa, Homo sapiens; identical to SEQ ID NO: 56965

SEQ ID NO: 56983 - protein, 158 aa, Homo sapiens; identical to SEQ ID NO: 56966

SEQ ID NO: 56984 - protein, 200 aa, Homo sapiens; identical to SEQ ID NO: 56963

SEQ ID NO: 56985 - protein, 200 aa, Homo sapiens
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALING

SEQ ID NO: 56986 - protein, 146 aa, Homo sapiens
MDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPVGSSVKANHGVQG

SEQ ID NO: 56987 - protein, 158 aa, Homo sapiens; identical to SEQ ID NO: 56966

SEQ ID NO: 56988 - protein, 302 aa, Homo sapiens; identical to SEQ ID NO: 56956

SEQ ID NO: 56989 - protein, 302 aa, Homo sapiens; identical to SEQ ID NO: 56956

SEQ ID NO: 56990 - protein, 302 aa, Homo sapiens; identical to SEQ ID NO: 56956

SEQ ID NO: 56991 - protein, 93 aa, Homo sapiens
MLGLWGQRLPAAWVLLLLPFLPLLLLAAPAPHRESYKPVIVVHGLFDSSYSFRHLLEYINEGALCAGLCFLSWMITTWILSSPSPLHRWDSME

SEQ ID NO: 56992 - protein, 200 aa, Homo sapiens; identical to SEQ ID NO: 56977

SEQ ID NO: 56993 - protein, 200 aa, Homo sapiens; identical to SEQ ID NO: 56977

SEQ ID NO: 56994 - protein, 302 aa, Homo sapiens; identical to SEQ ID NO: 56956

SEQ ID NO: 56995 - protein, 301 aa, Homo sapiens
MLGLCGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQSESWGPGLSCALS

SEQ ID NO: 56996 - protein, 158 aa, Homo sapiens; identical to SEQ ID NO: 56964

SEQ ID NO: 56997 - protein, 180 aa, Homo sapiens; identical to SEQ ID NO: 56965

SEQ ID NO: 56998 - protein, 200 aa, Homo sapiens; identical to SEQ ID NO: 56977

SEQ ID NO: 56999 - protein, 302 aa, Homo sapiens; identical to SEQ ID NO: 56956

SEQ ID NO: 57000 - protein, 302 aa, Homo sapiens; identical to SEQ ID NO: 56956

SEQ ID NO: 57001 - protein, 93 aa, Homo sapiens; identical to SEQ ID NO: 56960

SEQ ID NO: 57002 - protein, 93 aa, Homo sapiens
MLGLCGQRLPAAWVLLLLPFLPLLLLAAPAPHRASYKPVIVVHGLFDSSYSFRHLLEYINEGALCAGLCFLSWMITTWILSSPSPLHRWDSME

SEQ ID NO: 57003 - protein, 302 aa, Homo sapiens; identical to SEQ ID NO: 56956

SEQ ID NO: 57004 - protein, 302 aa, Homo sapiens; identical to SEQ ID NO: 56956

SEQ ID NO: 57005 - protein, 180 aa, Homo sapiens
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWH

SEQ ID NO: 57006 - protein, 180 aa, Homo sapiens; identical to SEQ ID NO: 57005

SEQ ID NO: 57007 - protein, 93 aa, Homo sapiens; identical to SEQ ID NO: 56991

SEQ ID NO: 57008 - protein, 236 aa, Homo sapiens; identical to SEQ ID NO: 56974

SEQ ID NO: 57009 - protein, 54 aa, Homo sapiens
  MOD_RES (1)..(1): Any amino acid
XHDDLYLNASSFLALINGERDHPNATVWRKNFLRVGHLVLIGGPDDGVITPWQS

SEQ ID NO: 57010 - protein, 236 aa, Homo sapiens; identical to SEQ ID NO: 56974

SEQ ID NO: 57011 - protein, 302 aa, Homo sapiens; identical to SEQ ID NO: 56956

SEQ ID NO: 57012 - protein, 302 aa, Homo sapiens; identical to SEQ ID NO: 56956

SEQ ID NO: 57013 - protein, 302 aa, Homo sapiens; identical to SEQ ID NO: 56956

SEQ ID NO: 57014 - protein, 146 aa, Homo sapiens; identical to SEQ ID NO: 56986

SEQ ID NO: 57015 - protein, 308 aa, Homo sapiens; identical to SEQ ID NO: 56951

SEQ ID NO: 57016 - protein, 293 aa, Homo sapiens; identical to SEQ ID NO: 44786

SEQ ID NO: 57017 - protein, 301 aa, Homo sapiens
MLGLWGQRLPAAWVLLLLPFLPLLLLAAPAPHRASYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQSESWGPGLSCALS

SEQ ID NO: 57018 - protein, 302 aa, Homo sapiens; identical to SEQ ID NO: 56953

SEQ ID NO: 57019 - protein, 146 aa, Homo sapiens; identical to SEQ ID NO: 56986

SEQ ID NO: 57020 - protein, 293 aa, Homo sapiens; identical to SEQ ID NO: 44786

SEQ ID NO: 57021 - protein, 301 aa, Homo sapiens; identical to SEQ ID NO: 57017

SEQ ID NO: 57022 - protein, 146 aa, Homo sapiens; identical to SEQ ID NO: 56986

SEQ ID NO: 57023 - protein, 301 aa, Homo sapiens; identical to SEQ ID NO: 57017

SEQ ID NO: 57024 - protein, 146 aa, Homo sapiens; identical to SEQ ID NO: 56986

SEQ ID NO: 57025 - protein, 293 aa, Homo sapiens; identical to SEQ ID NO: 44786

SEQ ID NO: 57026 - protein, 293 aa, Homo sapiens; identical to SEQ ID NO: 44786

SEQ ID NO: 57027 - protein, 302 aa, Homo sapiens; identical to SEQ ID NO: 56956

SEQ ID NO: 57028 - protein, 146 aa, Homo sapiens; identical to SEQ ID NO: 56986

SEQ ID NO: 57029 - protein, 302 aa, Homo sapiens; identical to SEQ ID NO: 56956

SEQ ID NO: 57030 - protein, 146 aa, Homo sapiens; identical to SEQ ID NO: 56986

SEQ ID NO: 57031 - protein, 301 aa, Homo sapiens; identical to SEQ ID NO: 57017

SEQ ID NO: 57032 - protein, 301 aa, Homo sapiens
MLGLWGQRLPAAWVLLLLPFLPLLLLAAPAPHRESYKPVIVVHGLFDSSYSFRHLLEYINETHPGTVVTVLDLFDGRESLRPLWEQVQGFREAVVPIMAKAPQGVHLICYSQGGLVCRALLSVMDDHNVDSFISLSSPQMGQYGDTDYLKWLFPTSMRSNLYRICYSPWGQEFSICNYWHDPHHDDLYLNASSFLALINGERDHPNATVWRKNFLRVGHLVLIGGPDDGVITPWQSSFFGFYDANETVLEMEEQLPARPTHQSELLLLRLVCLKPPRRKKPACRVQRQSESWGPGLSCALS

SEQ ID NO: 57033 - protein, 301 aa, Homo sapiens; identical to SEQ ID NO: 57017

SEQ ID NO: 57034 - protein, 302 aa, Homo sapiens; identical to SEQ ID NO: 56956

SEQ ID NO: 57035 - protein, 1201 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHIIEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSFCSSGDSVIGQLFSCEMENCSLCRCGSETVRASSTLLFTLSYPDGSKSDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 57036 - protein, 1202 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHIIEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDGSKSDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 57037 - protein, 1198 aa, Homo sapiens
MNFEGLDPGLAEYAPAMHSALDPVLDAHLNPSLLQNVELDPEGVALEALPVQESVHIMEGVYSELHSVVAEVGVPVSVSHFDLHEEMLWVGSHGGHATSFFGPALERYSSFQVNGSDDIRQIQSLENGILFLTKNNLKYMARGGLIIFDYLLDENEDMHSLLLTDSSTLLVGGLQNHIIEIDLNTVQETQKYAVETPGVTIMRQTNRFFFCGHTSGKVSLRDLRTFKVEHEFDAFSGSLSDFDVHGNLLAACGFSSRLTGLACDRFLKVYDLRMMRAITPLQVHVDPAFLRFIPTYTSRLAIISQSGQCQFCEPTGLANPADIFHVNPVGPLLMTFDVSASKQALAFGDSEGCVHLWTDSPEPSFNPYSRETEFALPCLVDSLPPLDWSQDLLPLSLIPVPLTTDTLLSDWPAANSAPAPRRAPPVDAEILRTMKKVGFIGYAPNPRTRLRNQIPYRLKESDSEFDSFSQVTESPVGREEEPHLHMVSKKYRKVTIKYSKLGLEDFDFKHYNKTLFAGLEPHIPNAYCNCMIQVLYFLEPVRCLIQNHLCQKEFCLACELGFLFHMLDLSRGDPCQGNNFLRAFRTIPEASALGLILADSDEASGKGNLARLIQRWNRFILTQLHQDMQELEIPQAYRGAGGSSFCSSGDSVIGQLFSCEMENCSLCRCGSETVRASSTLLFTLSYPDDKTGKNYDFAQVLKRSICLDQNTQAWCDTCEKYQPTIQTRNIRHLPDILVINCEVNSSKEADFWRMQAEVAFKMAVKKHGGEISKNKEFALADWKELGSPEGVLVCPSIEELKNVWLPFSIRMKMTKNKGLDVCNWTDGDEMQWGPARAEEEHGVYVYDLMATVVHILDSRTGGSLVAHIKVGETYHQRKEGVTHQQWYLFNDFLIEPIDKHEAVQFDMNWKVPAILYYVKRNLNSRYNLNIKNPIEASVLLAEASLARKQRKTHTTFIPLMLNEMPQIGDLVGLDAEFVTLNEEEAELRSDGTKSTIKPSQMSVARITCVRGQGPNEGIPFIDDYISTQEQVVDYLTQYSGIKPGDLDAKISSKHLTTLKSTYLKLRFLIDIGVKFVGHGLQKDFRVINLMVPKDQVLDTVYLFHMPRKRMISLRFLAWYFLDLKIQGETHDSIEDARTALQLYRKYLELSKNGTEPESFHKVLKGLYEKGRKMDWKVPEPEGQTSPKNAAVFSSVLAL

SEQ ID NO: 57038 - protein, 1202 aa, Homo sapiens; identical to SEQ ID NO: 57036

SEQ ID NO: 57039 - protein, 328 aa, Homo sapiens
MDAVLLEHFPGGLDAFPSSYFDEDDFFTDQSSRDPLEDGDELLADEQAEVEFLSHQLHEYCYRDGACLLLQPAPPAAPLALAPPSSGGLGEPDDGGGGGYCCETGAPPGGFPYSPGSPPSCLAYPCAGAAVLSPGARLRGLSGAAAAAARRRRRVRSEAELQQLRQAANVRERRRMQSINDAFEGLRSHIPTLPYEKRLSKVDTLRLAIGYINFLSELVQADLPLRGGGAGGCGGPGGGGRLGGDSPGSQAQKVIICHRGTRSPSPSDPDYGLPPLAGHSLSWTDEKQLKEQNIIRTAKVWTPEDPRKLNSKSSFNNIENEPPFEFVS

SEQ ID NO: 57040 - protein, 283 aa, Homo sapiens
MNGEEQYYAATQLYKDPCAFQRGPAPEFSASPPACLYMGRQPPPPPPHPFPGALGALEQGSPPDISPYEVPPLADDPAVAHLHHHLPAQLALPHPPAGPFPEGAEPGVLEEPNRVQLPFPWMKSTKAHAWKGQWAGGAYAAEPEENKRTRTAYTRAQLLELEKEFLFNKYISRPRRVELAVMLNLTERHIKIWFQNRRMKWKKEEDKKRGGGTAVGGGGVAEPEQDCAVTSGEELLALPPPPPPGGAVPPAAPVAAREGRLPPGLSASPQPSSVAPRRPQEPR

SEQ ID NO: 57041 - protein, 465 aa, Homo sapiens
MLPLWTLSLLLGAVAGKEVCYERLGCFSDDSPWSGITERPLHILPWSPKDVNTRFLLYTNENPNNFQEVAADSSSISGSNFKTNRKTRFIIHGFIDKGEENWLANVCKNLFKVESVNCICVDWKGGSRTGYTQASQNIRIVGAEVAYFVEFLQSAFGYSPSNVHVIGHSLGAHAAGEAGRRTNGTIGRITGLDPAEPCFQGTPELVRLDPSDAKFVDVIHTDGAPIVPNLGFGMSQVVGHLDFFPNGGVEMPGCKKNILSQIVDIDGIWEGTRDFAACNHLRSYKYYTDSIVNPDGFAGFPCASYNVFTANKCFPCPSGGCPQMGHYADRYPGKTNDVGQKFYLDTGDASNFARWRYKVSVTLSGKKVTGHILVSLFGNKGNSKQYEIFKGTLKPDSTHSNEFDSDVDVGDLQMVKFIWYNNVINPTLPRVGASKIIVETNVGKQFNFCSPETVREEVLLTLTPC

SEQ ID NO: 57042 - protein, 95 aa, Homo sapiens
MAAARLCLSLLLLSTCVALLLQPLLGAQGAPLEPVYPGDNATPEQMAQYAADLRRYINMLTRPRYGKRHKEDTLAFSEWGSPHAAVPRELSPLDL

SEQ ID NO: 57043 - protein, 375 aa, Homo sapiens
MNTSHLLALLLPKSPQGENRSKPLGTPYNFSEHCQDSVDVMVFIVTSYSIETVVGVLGNLCLMCVTVRQKEKANVTNLLIANLAFSDFLMCLLCQPLTAVYTIMDYWIFGETLCKMSAFIQCMSVTVSILSLVLVALERHQLIINPTGWKPSISQAYLGIVLIWVIACVLSLPFLANSILENVFHKNHSKALEFLADKVVCTESWPLAHHRTIYTTFLLLFQYCLPLGFILVCYARIYRRLQRQGRVFHKGTYSLRAGHMKQVNVVLVVMVVAFAVLWLPLHVFNSLEDWHHEAIPICHGNLIFLVCHLLAMASTCVNPFIYGFLNTNFKKEIKALVLTCQQSAPLEESEHLPLSTVHTEVSKGSLRLSGRSNPI

SEQ ID NO: 57044 - protein, 375 aa, Homo sapiens; identical to SEQ ID NO: 57043

SEQ ID NO: 57045 - protein, 598 aa, Homo sapiens
MLKLVGGGGGQDWACSVAGTSLGGEEAAFEVARPGDQGKAGGGSPGWGCAGIPDSAPGAGVLQAGAVGPARGGQGAEEVGESAGGGEERRVRHPQAPALRLLNRKPQGGSGEIKTPENDLQRGRLSRGPRTAPPAPGMGDRSGQQERSVPHSPGAPVGTSAAAVNGLLHNGFHPPPVQPPHVCSRGPVGGSDAAPQRLPLLPELQPQPLLPQHDSPAKKCRLRRRMDSGRKNRPPFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 57046 - protein, 314 aa, Homo sapiens
MKLINGKKQTFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 57047 - protein, 373 aa, Homo sapiens
MKLINGKKQTFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 57048 - protein, 400 aa, Homo sapiens
MAKSKHALLPFCHGMMQQEGLHQMQSLDLGLLSLQNSFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 57049 - protein, 461 aa, Homo sapiens
MGDRSGQQERSVPHSPGAPVGTSAAAVNGLLHNGFHPPPVQPPHVCSRGPVGGSDAAPQRLPLLPELQPQPLLPQHDSPAKKCRLRRRMDSGRKNRPPFPWFGMDIGGTLVKLVYFEPKDITAEEEQEEVENLKSIRKYLTSNTAYGKTGIRDVHLELKNLTMCGRKGNLHFIRFPSCAMHRFIQMGSEKNFSSLHTTLCATGGGAFKFEEDFRMIADLQLHKLDELDCLIQGLLYVDSVGFNGKPECYYFENPTNPELCQKKPYCLDNPYPMLLVNMGSGVSILAVYSKDNYKRVTGTSLGGGTFLGLCCLLTGCETFEEALEMAAKGDSTNVDKLVKDIYGGDYERFGLQGSAVASSFGNMMSKEKRDSISKEDLARATLVTITNNIGSIARMCALNENIDRVVFVGNFLRINMVSMKLLAYAMDFWSKGQLKALFLEHEGYFGAVGALLELFKMTDDK

SEQ ID NO: 57050 - protein, 570 aa, Homo sapiens
MRRLGPFHPRVHWAAPPSLSSGLHRLLFLRGTRIPSSTTLSPPRHDSLSLDGGTVNPPRVREPTGREAFGPSPASSDWLPARWRNGRGGRPRARLCSGWTAAEEARRNPTLGGLLGRQRLLLRMGGGRLGAPMERHGRASATSVSSAGEQAAGDPEGRRQEPLRRRASSASVPAVGASAEGTRRDRLGSYSGPTSVSRQRVESLRKKRPLFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 57051 - protein, 386 aa, Homo sapiens
SGRVNPAGGLGCSESGTFGGPPAPIVFPWFGLDIGGTLVKLVYFEPKDITAEEEEEEVESLKSIRKYLTSNVAYGSTGIRDVHLELKDLTLCGRKGNLHFIRFPTHDMPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 57052 - protein, 279 aa, Homo sapiens
MPAFIQMGRDKNFSSLHTVFCATGGGAYKFEQDFLTIGDLQLCKLDELDCLIKGILYIDSVGFNGRSQCYYFENPADSEKCQKLPFDLKNPYPLLLVNIGSGVSILAVYSKDNYKRVTGTSLGGGTFFGLCCLLTGCTTFEEALEMASRGDSTKVDKLVRDIYGGDYERFGLPGWAVASSFGNMMSKEKREAVSKEDLARATLITITNNIGSIARMCALNENINQVVFVGNFLRINTIAMRLLAYALDYWSKGQLKALFSEHEGYFGAVGALLELLKIP

SEQ ID NO: 57053 - protein, 370 aa, Homo sapiens
MKIKDAKKPSFPWFGMDIGGTLVKLSYFEPIDITAEEEQEEVESLKSIRKYLTSNVAYGSTGIRDVHLELKDLTLFGRRGNLHFIRFPTQDLPTFIQMGRDKNFSTLQTVLCATGGGAYKFEKDFRTIGNLHLHKLDELDCLVKGLLYIDSVSFNGQAECYYFANASEPERCQKMPFNLDDPYPLLVVNIGSGVSILAVHSKDNYKRVTGTSLGGGTFLGLCSLLTGCESFEEALEMASKGDSTQADKLVRDIYGGDYERFGLPGWAVASSFGNMIYKEKRESVSKEDLARATLVTITNNIGSVARMCAVNEKINRVVFVGNFLRVNTLSMKLLAYALDYWSKGQLKALFLEHEGYFGAVGALLGLPNFS

SEQ ID NO: 57054 - protein, 773 aa, Homo sapiens
MAECGASGSGSSGDSLDKSITLPPDEIFRNLENAKRFAIDIGGSLTKLAYYSTVQHKVAKVRSFDHSGKDTEREHEPPYEISVQEEITARLHFIKFENTYIEACLDFIKDHLVNTETKVIQATGGGAYKFKDLIEEKLRLKVDKEDVMTCLIKGCNFVLKNIPHEAFVYQKDSDPEFRFQTNHPHIFPYLLVNIGSGVSIVKVETEDRFEWVGGSSIGGGTFWGLGALLTKTKKFDELLHLASRGQHSNVDMLVRDVYGGAHQTLGLSGNLIASSFGKSATADQEFSKEDMAKSLLHMISNDIGQLACLHARLHSLDRVYFGGFFIRGHPVTMRTITYSINFFSKGEVQALFLRHEGYLGAIGAFLKGAEQDNPNQYSWGENYAGSSGLMSASPELGPAQRARSGTFDLLEMDRLERPLVDLPLLLDPPSYVPDTVDLTDDALARKYWLTCFEEALDGVVKRAVASQPDSVDAAERAEKFRQKYWNKLQTLRQQPFAYGTLTVRSLLDTREHCLNEFNFPDPYSKVKQRENGVALRCFPGVVRSLDALGWEERQLALVKGLLAGNVFDWGAKAVSAVLESDPYFGFEEAKRKLQERPWLVDSYSEWLQRLKGPPHKCALIFADNSGIDIILGVFPFVRELLLRGTEVILACNSGPALNDVTHSESLIVAERIAGMDPVVHSALQEERLLLVQTGSSSPCLDLSRLDKGLAALVRERGADLVVIEGMGRAVHTNYHAALRCESLKLAVIKNAWLAERLGGRLFSVIFKYEVPAE

SEQ ID NO: 57055 - protein, 484 aa, Homo sapiens
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPCFFQVNQKTEARHILTLVHKHFCTRLSGYIERPQLIRAKVPIVKFRDKVSCVEFDLNVNNIVGIRNTFLLRTYAYLENRVRPLVLVIKKWASHHQINDASRGTLSSYSLVLMVLHYLQTLPEPILPSLQKIYPESFSPAIQLHLVHQAPCNVPPYLSKNESNLGDLLLGFLKYYATEFDWNSQMISVREAKAIPRPDGIEWRNKYICVEEPFDGTNTARAVHEKQKFDMIKDQFLKSWHRLKNKRDLNSILPVRAAVLKR

SEQ ID NO: 57056 - protein, 480 aa, Homo sapiens
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPVNQKTEARHILTLVHKHFCTRLSGYIERPQLIRAKVPIVKFRDKVSCVEFDLNVNNIVGIRNTFLLRTYAYLENRVRPLVLVIKKWASHHQINDASRGTLSSYSLVLMVLHYLQTLPEPILPSLQKIYPESFSPAIQLHLVHQAPCNVPPYLSKNESNLGDLLLGFLKYYATEFDWNSQMISVREAKAIPRPDGIEWRNKYICVEEPFDGTNTARAVHEKQKFDMIKDQFLKSWHRLKNKRDLNSILPVRAAVLKR

SEQ ID NO: 57057 - protein, 484 aa, Homo sapiens; identical to SEQ ID NO: 57055

SEQ ID NO: 57058 - protein, 484 aa, Homo sapiens; identical to SEQ ID NO: 57055

SEQ ID NO: 57059 - protein, 491 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 57060 - protein, 459 aa, Homo sapiens
MSLVAYASSDESEPDEAEPEPEEEEAVAPTSGPALGGLFASLPAPKGPALLPPPPQMLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 57061 - protein, 467 aa, Homo sapiens
MLAPAFPPPLLLPPPTGDPRLQPPPPLPFGLGGFPPPPGVSPAEAAGVGEGLGLGLPSPRGPGLNLPPPIGGAGPPLGLPKPKKRKEPVKIAAPELHKGDSDSEEDEPTKKKTILQGSSEGTGLSALLPQPKNLTVKETNRLLLPHAFSRKPSDGSPDTKPSRLASKTKTSSLAPVVGTTTTTPSPSAIKAAAKSAALQVTKQITQEEDDSDEEVAPENFFSLPEKAEPPGVEPYPYPIPTVPEELPPGTEPEPAFQDDAANAPLEFKMAAGSSGAPWMPKPGDDYSYNQFSTYGDANAAGAYYQGLQQHLGHSPLRGIMRFLNSKSGKRTCFVPSFDYYSGGYYPAQDPALVPPQEIAPDASFIDDEAFKRLQGKRNRGREEINFVEIKGDDQLSGAQQWMTKSLTEEKTMKSFSKKKGEQPTGQQRRKHQITYLIHQAKERELELKNTWSENKLSRRQTQAKYGF

SEQ ID NO: 57062 - protein, 1031 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 57063 - protein, 1319 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGESGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 57064 - protein, 1310 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 57065 - protein, 179 aa, Homo sapiens
MQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGT

SEQ ID NO: 57066 - protein, 1001 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 57067 - protein, 988 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 57068 - protein, 1353 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 57069 - protein, 1356 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELNAEPSQMQIPKETKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGESGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 57070 - protein, 1296 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 57071 - protein, 1244 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGSSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 57072 - protein, 747 aa, Homo sapiens
MVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLVADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFSLAKLKPEKR

SEQ ID NO: 57073 - protein, 1266 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 57074 - protein, 1340 aa, Homo sapiens
MKVTVCFGRTRVVVPCGDGHMKVFSLIQQAVTRYRKAIAKDPNYWIQVHRLEHGDGGILDLDDILCDVADDKDRLVAVFDEQDPHHGGDGTSASSTGTQSPEIFGSELGTNNVSAFQPYQATSEIEVTPSVLRANMPLHVRRSSDPALIGLSTSVSDSNFSSEEPSRKNPTRWSTTAGFLKQNTAGSPKTCDRKKDENYRSLPRDTSNWSNQFQRDNARSSLSASHPMVGKWLEKQEQDEDGTEEDNSRVEPVGHADTGLEHIPNFSLDDMVKLVEVPNDGGPLGIHVVPFSARGGRTLGLLVKRLEKGGKAEHENLFRENDCIVRINDGDLRNRRFEQAQHMFRQAMRTPIIWFHVVPAANKEQYEQLSQSEKNNYYSSRFSPDSQYIDNRSVNSAGLHTVQRAPRLNHPPEQIDSHSRLPHSAHPSGKPPSAPASAPQNVFSTTVSSGYNTKKIGKRLNIQLKKGTEGLGFSITSRDVTIGGSAPIYVKNILPRGAAIQDGRLKAGDRLIEVNGVDLVGKSQEEVVSLLRSTKMEGTVSLLVFRQEDAFHPRELKAEDEDIVLTPDGTREFLTFEVPLNDSGSAGLGVSVKGNRSKENHADLGIFVKSIINGGAASKDGRLRVNDQLIAVNGESLLGKTNQDAMETLRRSMSTEGNKRGMIQLIVARRISKCNELKSPGSPPGPELPIETALDDRERRISHSLYSGIEGLDESPSRNAALSRIMGKYQLSPTVNMPQDDTVIIEDDRLPVLPPHLSDQSSSSSHDDVGFVTADAGTWAKAAISDSADCSLSPDVDPVLAFQREGFGRQSMSEKRTKQFSDASQLDFVKTRKSKSMDLGIADETKLNTVDDQKAGSPSRDVGPSLGLKKSSSLESLQTAVAEVTLNGDIPFHRPRPRIIRGRGCNESFRAAIDKSYDKPAVDDDDEGMETLEEDTEESSRSGRESVSTASDQPSHSLERQMNGNQEKGDKTDRKKDKTGKEKKKDRDKEKDKMKAKKGMLKGLGDMFRFGKHRKDDKIEKTGKIKIQESFTSEEERIRMKQEQERIQAKTREFRERQARERDYAEIQDFHRTFGCDDELMYGGVSSYEGSMALNARPQSPREGHMMDALYAQVKKPRNSKPSPVDSNRSTPSNHDRIQRLRQEFQQAKQDEDVEDRRRTYSFEQPWPNARPATQSGRHSVSVEVQMQRQRQEERESSQQAQRQYSSLPRQSRKNASSVSQDSWEQNYSPGEGFQSAKENPRYSSYQGSRNGYLGGHGFNARVMLETQELLRQEQRRKEQQMKKQPPSEGPSNYDSYKKVQDPSYAPPKGPFRQDVPPSPSQVARLNRLQTPEKGRPFYS

SEQ ID NO: 57075 - protein, 372 aa, Homo sapiens
MNRSHRHGAGSGCLGTMEVKSKFGAEFRRFSLERSKPGKFEEFYGLLQHVHKIPNVDVLVGYADIHGDLLPINNDDNYHKAVSTANPLLRIFIQKKEEADYSAFGTDTLIKKKNVLTNVLRPDNHRKKPHIVISMPQDFRPVSSIIDVDILPETHRRVRLYKYGTEKPLGFYIRDGSSVRVTPHGLEKVPGIFISRLVPGGLAQSTGLLAVNDEVLEVNGIEVSGKSLDQVTDMMIANSRNLIITVRPANQRNNVVRNSRTSGSSGQSTDNSLLGYPQQIEPSFEPEDEDSEEDDIIIEDNGVPQQIPKAVPNTESLESLTQIELSFESGQNGFIPSNEVSLAAIASSSNTEFETHAPDQKLLEEDGTIITL

SEQ ID NO: 57076 - protein, 376 aa, Homo sapiens
MNRSFHKSQTLRFYDCSAVEVKSKFGAEFRRFSLDRHKPGKFEDFYKLVVHTHHISNSDVTIGYADVHGDLLPINNDDNFCKAVSSANPLLRVFIQKREEAERGSLGAGSLCRRRRALGALRDEGPRRRAHLDIGLPRDFRPVSSIIDVDLVPETHRRVRLHRHGCEKPLGFYIRDGASVRVTPHGLEKVPGIFISRMVPGGLAESTGLLAVNDEVLEVNGIEVAGKTLDQVTDMMIANSHNLIVTVKPANQRNNVVRGGRALGSSGPPSDGTAGFVGPPAPRVLQNFHPDEAESDEDNDVVIEGTLEPARPPQTPGAPAGSLSRVNGAGLAQRLQRDLALDGGLQRLLSSLRADPRHSLALPPGGVEEHGPAVTL

SEQ ID NO: 57077 - protein, 411 aa, Homo sapiens
MAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 57078 - protein, 379 aa, Homo sapiens
MEMAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 57079 - protein, 413 aa, Homo sapiens
MEMAEAELHKERLQAIAEKRKRQTEIEGKRQQLDEQILLLQHSKSKVLREKWLLQGIPAGTAEEEEARRRQSEEDEFRVKQLEDNIQRLEQEIQTLESEESQISAKEQIILEKLKETEKSFKDFQKGFSSTDGDAVNYISSQLPDLPILCSRTAEPSPGQDGTSRAAAVYAMEINVEKDKQTGETKILSTSTIGPEGVHQKGVKVYDDGTKVVYEVRSGGTVVENGVHKLSTKDVEELIQKAGQSSLGGGHVSERTVIADGSLSHPKEHMLCKEAKLEMVHKSRKDHSSGNPGQQAQAPSAAGPEANLDQPVTMIFMGYQNIEDEEETKKVLGYDETIKAELVLIDEDDEKSLREKTVTDVSTIDGNAAELVSGRPVSDTTEPSSPEGKEESLATEPAPGTQKKKRCQCCVVM

SEQ ID NO: 57080 - protein, 355 aa, Homo sapiens [sequence omitted]

SEQ ID NO: 57081 - protein, 355 aa, Homo sapiens
MGKLVALVLLGVGLSLVGEMFLAFRERVNASREVEPVEPENCHLIEELETGSEDLEILPNGLAFISSGLKYPGIKSFNPNSPGKILLMDLNEEDPTVLELGITGSKFDVSSFNPHGISTFTDEDNAMYLLVVNHPDAKSTVELFKFQEEEKSLLHLKTIRHKLLPNLNDIVAVGPEHFYGTNDHYFLDPYLQSWEMYLGLAWSYVVYYSPSEVRVVAEGFDFANGINISPDGKYVYIAELLAHKIHVYEKHANWTLTPLKSLDFNTLVDNISVDPETGDLWVGCHPNGMKIFFYDSENPPASEVLRIQNILTEEPKVTQVYAENGTVLQGSTVASVYKGKLLIGTVFHKALYCEL

SEQ ID NO: 57082 - protein, 354 aa, Homo sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 57083 - protein, 352 aa, Homo sapiens
GAAGGCGLAGDRAGLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 57084 - protein, 375 aa, Homo sapiens
MAPPTELLARPERGSAPGSRAMGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNDDTVYLFVVNHPEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 57085 - protein, 342 aa, Homo sapiens
MGRLVAVGLLGIALALLGERLLALRNRLKASREVESVDLPHCHLIKGIEAGSEDIDILPNGLAFFSVGLKFPGLHSFAPDKPGGILMMDLKEEKPRARELRISRGFDLASFNPHGISTFIDNEFKNTVEIFKFEEAENSLLHLKTVKHELLPSVNDITAVGPAHFYATNDHYFSDPFLKYLETYLNLHWANVVYYSPNEVKVVAEGFDSANGINISPDDKYIYVADILAHEIHVLEKHTNMNLTQLKVLELDTLVDNLSIDPSSGDIWVGCHPNGQKLFVYDPNNPPSSEVLRIQNILSEKPTVTTVYANNGSVLQGSSVASVYDGKLLIGTLYHRALYCEL

SEQ ID NO: 57086 - protein, 354 aa, Homo sapiens
MGKLVALVLLGVGLSLVGEMFLAFRERVNASREVEPVEPENCHLIEELESGSEDIDILPSGLAFISSGLKYPGMPNFAPDEPGKIFLMDLNEQNPRAQALEISGGFDKELFNPHGISIFIDKDNTVYLYVVNHPHMKSTVEIFKFEEQQRSLVYLKTIKHELLKSVNDIVVLGPEQFYATRDHYFTNSLLSFFEMILDLRWTYVLFYSPREVKVVAKGFCSANGITVSADQKYVYVADVAAKNIHIMEKHDNWDLTQLKVIQLGTLVDNLTVDPATGDILAGCHPNPMKLLNYNPEDPPGSEVLRIQNVLSEKPRVSTVYANNGSVLQGTSVASVYHGKILIGTVFHKTLYCEL

SEQ ID NO: 57087 - protein, 523 aa, Homo sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENREQEMRMGDMGPRGAINMGDAFSPAPAGNQGPPPMMGMNMNNRATIPGPPMGPGPAMGPEGAANMGTPMMPDNGAVHNDRFPQGPPSQMGSPMGSRTGSETPQAPMSGVGPVSGGPGGFGRGSQGGNFEGPNKRRRY

SEQ ID NO: 57088 - protein, 463 aa, Homo sapiens
MGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKLMQKTQQYHKEREQPPRFAQPGTFEFEYASRWKALDEMEKQQREQVDRNIREAKEKLEAEMEAARHEHQLMLMRQDLMRRQEELRRLEELRNQELQKRKQIQLRHEEEHRRREEEMIRHREQEELRRQQEGFKPNYMENREQEMRMGDMGPRGAINMGDAFSPAPAGNQGPPPMMGMNMNNRATIPGPPMGPGPAMGPEGAANMGTPMMPDNGAVHNDRFPQGPPSQMGSPMGSRTGSETPQAPMSGVGPVSGGPGGFGRGSQGGNFEGPNKRRRY

SEQ ID NO: 57089 - protein, 248 aa, Homo sapiens
MMLRGNLKQVRIEKNPARLRALESAVGESEPAAAAAMALALAGEPAPPAPAPPEDHPDEEMGFTIDIKSFLKPGEKTYTQRCRLFVGNLPTDITEEDFKRLFERYGEPSEVFINRDRGFGFIRLESRTLAEIAKAELDGTILKSRPLRIRFATHGAALTVKNLSPVVSNELLEQAFSQFGPVEKAVVVVDDRGRATGKGFVEFAAKPPARKALERCGDGAFLLTTTPRPVIVEPMEQFDDEDGLPEKL

SEQ ID NO: 57090 - protein, 102 aa, Homo sapiens
MSEKSVEAAAELSAKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 57091 - protein, 104 aa, Homo sapiens
MSEKSVEAAAELSAKDLKEKKEKVEEKASRKERKKEVVEAPVPLVVMVGKACSQPEATPSPGPHRRRRTGLRRKKKKLPRMERRKMKGKKKMRKKKKRMMKGPR

SEQ ID NO: 57092 - protein, 101 aa, Homo sapiens
SRDPACRAAELSAKDLKEKKEKVEEKASRKERKKEVVEEEENGAEEEEEETAEDGEEEDEGEEEDEEEEEEDDEGPALKRAAEEEDEADPKRQKTENGASA

SEQ ID NO: 57093 - protein, 175 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSR

SEQ ID NO: 57094 - protein, 209 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRTALLWGLKKKKENNRRTHHMQLMISLFKSPLLLL

SEQ ID NO: 57095 - protein, 175 aa, Homo sapiens; identical to SEQ ID NO: 57093

SEQ ID NO: 57096 - protein, 177 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLELDSRRH

SEQ ID NO: 57097 - protein, 175 aa, Homo sapiens; identical to SEQ ID NO: 57093

SEQ ID NO: 57098 - protein, 26 aa, Homo sapiens
TALLWGLKKKGKQQKNTSYATNDLII

SEQ ID NO: 57099 - protein, 209 aa, Homo sapiens; identical to SEQ ID NO: 57094

SEQ ID NO: 57100 - protein, 177 aa, Homo sapiens; identical to SEQ ID NO: 57096

SEQ ID NO: 57101 - protein, 172 aa, Homo sapiens
MQRRLVQQWSVAVFLLSYAVPSCGRSVEGLSRRLKRAVSEHQLLHDKGKSIQDLRRRFFLHHLIAEIHTAEIRATSEVSPNSKPSPNTKNHPVRFGSDDEGRYLTQETNKVETYKEQPLKTPGKKKKGKPGKRKEQEKKKRRTRSAWLDSGVTGSGLEGDHLSDTSTTSLEL

SEQ ID NO: 57102 - protein, 177 aa, Homo sapiens; identical to SEQ ID NO: 57096

SEQ ID NO: 57103 - protein, 296 aa, Homo sapiens
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNGSYSLPRLECSGAIMARCNLDHLGSSDPPTSASQVAEIIVNSGDGIDYSQQKRENIGDLIQETLEAFERYGGENAFINIKYVVPTYESCLLN

SEQ ID NO: 57104 - protein, 257 aa, Homo sapiens
MVAEKETLSLNKCPDKMPKRTKLLAQQPLPVHQPHSLVSEGFTVKAMMKNSVVRGPPAAGAFKERPTKPTAFRKFYERGDFPIALEHDSKGNKIAWKVEIEKLDYHHYLPLFFDGLCEMTFPYEFFARQGIHDMLEHGGNKILPVLPQLIIPIKNALNLRNRQVICVTLKVLQHLVVSAEMVGKALVPYYRQILPVLNIFKNMNVNSGDGIDYSQQKRENIGDLIQETLEAFERYGGENAFINIKYVVPTYESCLLN

SEQ ID NO: 57105 - protein, 257 aa, Homo sapiens; identical to SEQ ID NO: 57104

SEQ ID NO: 57106 - protein, 274 aa, Homo sapiens
MSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 57107 - protein, 368 aa, Homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGYGQRRTK

SEQ ID NO: 57108 - protein, 274 aa, Homo sapiens; identical to SEQ ID NO: 57106

SEQ ID NO: 57109 - protein, 218 aa, Homo sapiens
MNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVVSLLPSQ

SEQ ID NO: 57110 - protein, 316 aa, Homo sapiens
MIVFVRFNSSHGFPVEVDSDTSIFQLKEVVAKRQGVPADQLRVIFAGKELRNDWTVQEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 57111 - protein, 437 aa, Homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 57112 - protein, 465 aa, Homo sapiens
MIVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPAGRSIYNSFYVYCKGPCQRVQPGKLRVQCSTCRQATLTLTQGPSCWDDVLIPNRMSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQAYRVDERAAEQARWEAASKETIKKTTKPCPRCHVPVEKNGGCMHMKCPQPQCRLEWCWNCGCEWNRVCMGDHWFDV

SEQ ID NO: 57113 - protein, 203 aa, Homo sapiens
MSGECQSPHCPGTSAEFFFKCGAHPTSDKETSVALHLIATNSRNITCITCTDVRSPVLVFQCNSRHVICLDCFHLYCVTRLNDRQFVHDPQLGYSLPCVAGCPNSLIKELHHFRILGEEQYNRYQQYGAEECVLQMGGVLCPRPGCGAGLLPEPDQRKVTCEGGNGLGCGFAFCRECKEAYHEGECSAVFEASGTTTQHSGCT

SEQ ID NO: 57114 - protein, 142 aa, Homo sapiens
SVFVRFNSSHGFPVEVDSDTSIFQLKEVVAKRQGVPADQLRVIFAGKELRNDWTVQNCDLDQQSIVHIVQRPWRKGQEMNATGGDDPRNAAGGCEREPQSLTRVDLSSSVLPGDSVGLAVILHTDSRKDSPPAGSPGNCLHG

SEQ ID NO: 57115 - protein, 142 aa, Homo sapiens
MAAVVAATALKGRGARNARVLRGILAGATANKASHNRTRALQSHSSPEGKEEPEPLSPELEYIPRKRGKNPMKAVGLAWAIGFPCGILLFILTKREVDKDRVKQMKARQNMRLSNTGEYESQRFRASSQSAPSPDVGSGVQT

SEQ ID NO: 57116 - protein, 361 aa, Homo sapiens
MAWQGWPAAWQWVAGCWLLLVLVLVLLVSPRGCRARRGLRGLLMAHSQRLLFRIGYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 57117 - protein, 385 aa, Homo sapiens
MAAVVAATALKGRGARNARVLRGILAGATANKASHNRTRALQSHSSPEGKEEPEPLSPELEYIPRKRGKNPMKAVGLAWYSLYTRTWLGYLFYRQQLRRARNRYPKGHSKTQPRLFNGVKVLPIPVLSDNYSYLIIDTQAQLAVAVDPSDPRAVQASIEKEGVTLVAILCTHKHWDHSGGNRDLSRRHRDCRVYGSPQDGIPYLTHPLCHQDVVSVGRLQIRALATPGHTQGHLVYLLDGEPYKGPSCLFSGDLLFLSGCGRTFEGNAETMLSSLDTVLGLGDDTLLWPGHEYAEENLGFAGVVEPENLARERKMQWVQRQRLERKGTCPSTLGEERSYNPFLRTHCLALQEALGPGPGPTGDDDYSRAQLLEELRRLKDMHKSK

SEQ ID NO: 57118 - protein, 110 aa, Homo sapiens
MSMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVDEFSTLVAES

SEQ ID NO: 57119 - protein, 78 aa, Homo sapiens
MVGLKKKSADDVKKVFHMLDKDKSGFIEEDELGFILKGFSPDARDLSAKETKMLMAAGDKDGDGKIGVDEFSTLVAES

SEQ ID NO: 57120 - protein, 110 aa, Homo sapiens; identical to SEQ ID NO: 57118

SEQ ID NO: 57121 - protein, 101 aa, Homo sapiens
MSMTDLLNAEDIKKAVGAFSATDSFDHKKFFQMVGLKKKSADDVKKVFHMLDKDKSGFIEEDELGFILKGFSPDARDLSAKETKMLMAAGDKDGDGKIGVD

SEQ ID NO: 57122 - protein, 327 aa, Homo sapiens
MSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 57123 - protein, 412 aa, Homo sapiens
MLGIIPLPFGKPQPQSRRRPLRPPSASSASRPARGSLRRAMATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 57124 - protein, 290 aa, Homo sapiens
MNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKVGKGCLGWTEGSEMQQNIGKTHPCSLRASCQNWWHHLTSAHTGLSPLPSMYLSVPHWMLHLGLFPSISMNSLSSHPG

SEQ ID NO: 57125 - protein, 372 aa, Homo sapiens
MATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEYVSSRHKRDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 57126 - protein, 372 aa, Homo sapiens
MATSPQKSPSVPKSPTPKSPPSRKKDDSFLGKLGGTLARRKKAKEVSELQEEGMNAINLPLSPIPFELDPEDTMLEENEVRTMVDPNSRSDPKLQELMKVLIDWINDVLVGERIIVKDLAEDLYDGQVLQKLFEKLESEKLNVAEVTQSEIAQKQKLQTVLEKINETLKLPPRSIKWNVDSVHAKSLVAILHLLVALSQYFRAPIRLPDHVSIQVVVVQKREGILQSRQIQEEITGNTEALSGRHERDAFDTLFDHAPDKLNVVKKTLITFVNKHLNKLNLEVTELETQFADGVYLVLLMGLLEGYFVPLHSFFLTPDSFEQKVLNVSFAFELMQDGGLEKPKPRPEDIVNCDLKSTLRVLYNLFTKYRNVE

SEQ ID NO: 57127 - protein, 364 aa, Homo sapiens
MSSAPRSPTPRPRRMKKDESFLGKLGGTLARKRRAREVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 57128 - protein, 397 aa, Homo sapiens
MHHVFKDHQRGEKRGFLSPENKNCRRLELRRGCSCSWGLCSQALMASLAGSLLPGSDRSGVETSEYAQGGVSDLQEEGKNAINSPMSPALVDVHPEDTQLEENEERTMIDPTSKEDPKFKELVKVLLDWINDVLVEERIIVKQLEEDLYDGQVLQKLLEKLAGCKLNVAEVTQSEIGQKQKLQTVLEAVHDLLRPRGWALRWSVDSIHGKNLVAILHLLVSLAMHFRAPIRLPEHVTVQVVVVRKREGLLHSSHISEELTTTTEMMMGRFERDAFDTLFDHAPDKLSVVKKSLITFVNKHLNKLNLEVTELETQFADGVYLVLLMGLLEDYFVPLHHFYLTPESFDQKVHNVSFAFELMLDGGLKKPKARPEDVVNLDLKSTLRVLYNLFTKYKNVE

SEQ ID NO: 57129 - protein, 331 aa, Homo sapiens
MEPEFLYDLLQLPKGVEPPAEEELSKGGKKKYLPPTSRKDPKFEELQKVLMEWINATLLPEHIVVRSLEEDMFDGLILHHLFQRLAALKLEAEDIALTATSQKHKLTVVLEAVNRSLQLEEWQAKWSVESIFNKDLLSTLHLLVALAKRFQPDLSLPTNVQVEVITIESTKSGLKSEKLVEQLTEYSTDKDEPPKDVFDELFKLAPEKVNAVKEAIVNFVNQKLDRLGLSVQNLDTQFADGVILLLLIGQLEGFFLHLKEFYLTPNSPAEMLHNVTLALELLKDEGLLSCPVSPEDIVNKDAKSTLRVLYGLFCKHTQKAHRDRTPHGAPN

SEQ ID NO: 57130 - protein, 26 aa, Homo sapiens
MEPEFLYDLLQLPKGVEPPAEEELSK

SEQ ID NO: 57131 - protein, 30 aa, Homo sapiens
MEPEFLYDLLQLPKGVEPPAEEELSKGVCP

SEQ ID NO: 57132 - protein, 331 aa, Homo sapiens; identical to SEQ ID NO: 57129

SEQ ID NO: 57133 - protein, 331 aa, Homo sapiens; identical to SEQ ID NO: 57129

SEQ ID NO: 57134 - protein, 137 aa, Homo sapiens
MVPAKEQVPGRCDSTQRCFPGPSNWTGAGGRAGSQPFVGDGTLGTPNFCWDHKEKRAAESQLQAWEAMEPEFLYDLLQLPKGVEPPAEEELSKGGKKKYLPPTSRKDPKFEELQKHTWPSPVTGTGDTICGLARKTW

SEQ ID NO: 57135 - protein, 1323 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 57136 - protein, 1330 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQVRAGQSRLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 57137 - protein, 1323 aa, Homo sapiens; identical to SEQ ID NO: 57135

SEQ ID NO: 57138 - protein, 125 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPA

SEQ ID NO: 57139 - protein, 1107 aa, Homo sapiens
MKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 57140 - protein, 1137 aa, Homo sapiens
MGFPDSARAGQRSLVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQLVSAVGYLRLKDIIHRDIKDENIVIAEDFTIKLIDFGSAAYLERGKLFYTFCGTIEYCAPEVLMGNPYRGPELEMWSLGVTLYTLVFEENPFCELEETVEAAIHPPYLVSKELMSLVSGLLQPVPERRTTLEKLVTDPWVTQPVNLADYTWEEVFRVNKPESGVLSAASLEMGNRSLSDVAQAQELCGGPVPGEAPNGQGCLHPGDPRLLTS

SEQ ID NO: 57141 - protein, 1143 aa, Homo sapiens
MEDGGLTAFEEDQRCLSQSLPLPVSAEGPAAQTTAEPSRSFSSAHRHLSRRNGLSRLCQSRTALSEDRWSSYCLSSLAAQNICTSKLHCPAAPEHTDPSEPRGSVSCCSLLRGLSSGWSSPLLPAPVCNPNKAIFTVDAKTTEILVANDKACGLLGYSSQDLIGQKLTQFFLRSDSDVVEALSEEHMEADGHAAVVFGTVVDIISRSGEKIPVSVWMKRMRQERRLCCVVVLEPVERVSTWVAFQSDGTVTSCDSLFAHLHGYVSGEDVAGQHITDLIPSVQLPPSGQHIPKNLKIQRSVGRARDGTTFPLSLKLKSQPSSEEATTGEAAPVSGYRASVWVFCTISGLITLLPDGTIHGINHSFALTLFGYGKTELLGKNITFLIPGFYSYMDLAYNSSLQLPDLASCLDVGNESGCGERTLDPWQGQDPAEGGQDPRINVVLAGGHVVPRDEIRKLMESQDIFTGTQTELIAGGQLLSCLSPQPAPGVDNVPEGSLPVHGEQALPKDQQITALGREEPVAIESPGQDLLGESRSEPVDVKPFASCEDSEAPVPAEDGGSDAGMCGLCQKAQLERMGVSGPSGSDLWAGAAVAKPQAKGQLAGGSLLMHCPCYGSEWGLWWRSQDLAPSPSGMAGLSFGTPTLDEPWLGVENDREELQTCLIKEQLSQLSLAGALDVPHAELVPTECQAVTAPVSSCDLGGRDLCGGCTGSSSACYALATDLPGGLEAVEAQEVDVNSFSWNLKELFFSDQTDQTSSNCSCATSELRETPSSLAVGSDPDVGSLQEQGSCVLDDRELLLLTGTCVDLGQGRRFRESCVGHDPTEPLEVCLVSSEHYAASDRESPGHVPSTLDAGPEDTCPSAEEPRLNVQVTSTPVIVMRGAAGLQREIQEGAYSGSCYHRDGLRLSIQFEVRRVELQGPTPLFCCWLVKDLLHSQRDSAARTRLFLASLPGSTHSTAAELTGPSLVEVLRARPWFEEPPKAVELEGLAACEGEYSQKYSTMSPLGSGAFGFVWTAVDKEKNKEVVVKFIKKEKVLEDCWIEDPKLGKVTLEIAILSRVEHANIIKVLDIFENQGFFQLVMEKHGSGLDLFAFIDRHPRLDEPLASYIFRQVRAGQSRVSVNAGLGAWVRWLQRSVIHTRFSL

SEQ ID NO: 57142 - protein, 437 aa, Homo sapiens
MVQMMRQFLYRVLPEDSYKVTTGKLHVSLTRLTDGENVVVSEFTSKEELIEALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSPRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 57143 - protein, 532 aa, Homo sapiens
MEEQVFKGDPDTPHSISFSGSGFLSFYQAGAVDALRDLAPRMLETAHRFAGTSAGAVIAALAICGIEMDEYLRVLNVGVAEVKKSFLGPLSPSCKMVQMMRQFLYRVLPEDSYKVTTGKLHVSLTRLTDGENVVVSEFTSKEELIEALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSPRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 57144 - protein, 533 aa, Homo sapiens
MEEQVFKGDPDTPHSISFSGSGFLSFYQAGAVDALRDLAPRMLETAHRFAGTSAGAVIAALAICGIEMDEYLRVLNVGVAEVKKSFLGPLSPSCKMVQMMRQFLYRVLPEDSYKVTTGKLHVSLTRLTDGENVVVSEFTSKEELIEAALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSPRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 57145 - protein, 446 aa, Homo sapiens
MVQMMRQFLYRVLPEDSYKVTTGKLHVSLTRLTDGENVVVSEFTSKEELIEALYCSCFVPVYCGLIPPTYRGVWAFLTLPPQRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPLEQPPAQPLASSTPLSLSGMPPVSFPAVHKPPSSTPGSSLPTPPPGLSPLSPQQQVQPSGSPARSLHSQAPTSPRPSLGPSTVGAPQTLPRSSLSAFPAQPPVEELGQEQPQAVALLVSSKPKSAVPLVHVKETVSKPYVTESPAEDSNWVNKVFKKNKQKTSGTRKGFPRHSGSKKPSSKVQ

SEQ ID NO: 57146 - protein, 504 aa, Homo sapiens
MFPREKTWNISFAGCGFLGVYYVGVASCLREHAPFLVANATHIYGASAGALTATALVTGVCLGEAGAKFIEVSKEARKRFLGPLHPSFNLVKIIRSFLLKVLPADSHEHASGRLGISLTRVSDGENVIISHFNSKDELIQANVCSGFIPVYCGLIPPSLQGVRYVDGGISDNLPLYELKNTITVSPFSGESDICPQDSSTNIHELRVTNTSIQFNLRNLYRLSKALFPPEPLVLREMCKQGYRDGLRFLQRNGLLNRPNPLLALPPARPHGPEDKDQAVESAQAEDYSQLPGEDHILEHLPARLNEALLEACVEPTDLLTTLSNMLPVRLATAMMVPYTLPLESALSFTIRLLEWLPDVPEDIRWMKEQTGSICQYLVMRAKRKLGRHLPSRLPEQVELRRVQSLPSVPLSCAAYREALPGWMRNNLSLGDALAKWEECQRQLLLGLFCTNVAFPPEALRMRAPADPAPAPADPASPQHQLAGPAPLLSTPAPEARPVIGALGL

SEQ ID NO: 57147 - protein, 481 aa, Homo sapiens
MYDAERGWSLSFAGCGFLGFYHVGATRCLSEHAPHLLRDARMLFGASAGALHCVGVLSGIPLEQTLQVLSDLVRKARSRNIGIFHPSFNLSKFLRQGLCKCLPANVHQLISGKIGISLTRVSDGENVLVSDFRSKDEVVDALVCSCFIPFYSGLIPPSFRGVRYVDGGVSDNVPFIDAKTTITVSPFYGEYDICPKVKSTNFLHVDITKLSLRLCTGNLYLLSRAFVPPDLKVLGEICLRGYLDAFRFLEEKGICNRPQPGLKSSSEGMDPEVAMPSWANMSLDSSPESAALAVRLEGDELLDHLRLSILPWDESILDTLSPRLATALSEEMKDKGGYMSKICNLLPIRIMSYVMLPCTLPVESAIAIVQRLVTWLPDMPDDVLWLQWVTSQVFTRVLMCLLPASRSQMPVSSQQASPCTPEQDWPCWTPCSPKGCPAETKAEATPRSILRSSLNFFLGNKVPAGAEGLSTFPSFSLEKSL

SEQ ID NO: 57148 - protein, 429 aa, Homo sapiens
MGFLEEEGRWNLSFSGAGYLGAHHVGATECLRQRAPRLLQGARRIYGSSSGALNAVSIVCGKSVDFCCSHLLGMVGQLERLSLSILHPAYAPIEHVKQQLQDALPPDAHVLASQRLGISLTRWPDGRNFLVTDFATCDELIQALVCTLYFPFYCGLIPPEFRGERYIDGALSNNLPFADCPSTITVSPFHGTVDICPQSTSPNLHELNVFNFSFQISTENFFLGLICLIPPSLEVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSRRLVVWLPDVPADLWWMQGLLRNMALEVFSRTKAQLLGPISPPATRVLETSPLQPQIAPHREELGPTHQA

SEQ ID NO: 57149 - protein, 315 aa, Homo sapiens
MGFLEEEGRWNLSFSGAGYLGAHHVGATECLRQRAPRLLQGARRIYGSSSGALNAVSIVCGKSVDCPSTITVSPFHGTVDICPQSTSPNLHELNVFNFSFQISTENFFLGLICLIPPSLEVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSRRLVVWLPDVPADLWWMQGLLRNMALEVFSRTKAQLLGPISPPATRVLETSPLQPQIAPHREELGPTHQA

SEQ ID NO: 57150 - protein, 268 aa, Homo sapiens
MGFLEEEGRWNLSFSGAGYLGAHHVGATECLRQRAPRLLQGARRIYGSSSGALNAVSIVCGKSVDFCCSHLLGMVGQLERLSLSILHPAYAPIEHVKQQLQDALPPDAHVLASQRLGISLTRWPDGRNFLVTDFATCDELIQVVADNCRQGYLDALRFLERRGLTKEPVLWTLVSKEPPAPADGNWDAGCDQRWKGGLSLNWKVPHVQVKDVPNFEQLSPELEAALKKACTRDPSRWARFWHSGPGQVLTYLLLPCTLPFEYIYFRSR

SEQ ID NO: 57151 - protein, 315 aa, Homo sapiens; identical to SEQ ID NO: 57149

SEQ ID NO: 57152 - protein, 1327 aa, Homo sapiens
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 57153 - protein, 1375 aa, Homo sapiens
MEAPLQTGMMGTSSHGLATNSSGAKVAERDGFQDVLAPGEGSAGRICGAQPVPFVPQVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPAGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 57154 - protein, 1327 aa, Homo sapiens; identical to SEQ ID NO: 57152

SEQ ID NO: 57155 - protein, 456 aa, Homo sapiens
MRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDPSLLNSRVLLHHAKAGTIIARQGDQDVSGPHTGLTCPERGCSVALMT

SEQ ID NO: 57156 - protein, 1300 aa, Homo sapiens
MEAPLQTGMVLGVMIGAGVAVVVTAVLILLVVRRLRVPKTPAPDGPRYRFRKRDKVLFYGRKIMRKVSQSTSSLVDTSVSATSRPRMRKKLKMLNIAKKILRIQKETPTLQRKEPPPAVLEADLTEGDLANSHLPSEVLYMLKNVRVLGHFEKPLFLELCRHMVFQRLGQGDYVFRPGQPDASIYVVQDGLLELCLPGPDGKECVVKEVVPGDSVNSLLSILDVITGHQHPQRTVSARAARDSTVLRLPVEAFSAVFTKYPESLVRVVQIIMVRLQRVTFLALHNYLGLTNELFSHEIQPLRLFPSPGLPTRTSPVRGSKRMVSTSATDEPRETPGRPPDPTGAPLPGPTGDPVKPTSLETPSAPLLSRCVSMPGDISGLQGGPRSDFDMAYERGRISVSLQEEASGGSLAAPARTPTQEPREQPAGACEYSYCEDESATGGCPFGPYQGRQTSSIFEAAKQELAKLMRIEDVSLHFVLWGCLHVYQRMIDKAEDVCLFVAQPGELVGQLAVLTGEPLIFTLRAQRDCTFLRISKSDFYEIMRAQPSVVLSAAHTVAARMSPFVRQMDFAIDWTAVEAGRALYRQGDRSDCTYIVLNGRLRSVIQRGSGKKELVGEYGRGDLIGVVEALTRQPRATTVHAVRDTELAKLPEGTLGHIKRRYPQVVTRLIHLLSQKILGNLQQLQGPFPGSGLGVPPHSELTNPASNLATVAILPVCAEVPMVAFTLELQHALQAIGPTLLLNSDIIRARLGASALDSIQEFRLSGWLAQQEDAHRIVLYQTDASLTPWTVRCLRQADCILIVGLGDQEPTLGQLEQMLENTAVRALKQLVLLHREEGAGPTRTVEWLNMRSWCSGHLHLRCPRRLFSRRSPAKLHELYEKVFSRRADRHSDFSRLARVLTGNTIALVLGGGGARGCSHIGVLKALEEAGVPVDLVGGTSIGSFIGALYAEERSASRTKQRAREWAKSMTSVLEPVLDLTYPVTSMFTGSAFNRSIHRVFQDKQIEDLWLPYFNVTTDITASAMRVHKDGSLWRYVRASMTLSGYLPPLCDPKDGHLLMDGGYINNLPADIARSMGAKTVIAIDVGSQDETDLSTYGDSLSGWWLLWKRLNPWADKVKVPDMAEIQSRLAYVSCVRQLEVVKSSSYCEYLRPPIDCFKTMDFGKFDQIYDVGYQYGKAVFGGWSRGNVIEKMLTDRRSTDLNESRRADVLAFPSSGFTDLAEIVSRIEPPTSYVSDGCADGEESDCLTEYEEDAGPDCSRDEGGSPEGASPSTASEMEEEKSILRQRRCLPQEPPGSATDA

SEQ ID NO: 57157 - protein, 1317 aa, Homo sapiens
MEEEKDDSPQLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYEIMRKQPTVVLGVAHTVVKRMSSFVRQIDFALDWVEVEAGRAIYRQGDKSDCTYIMLSGRLRSVIRKDDGKKRLAGEYGRGDLVGVVETLTHQARATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQVDGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 57158 - protein, 725 aa, Homo sapiens
MVRLQRVTFLALHNYLGLTTELFNAESQAIPLVSVASVAAGKAKKQVFYGEEERLKKPPRLQESCDSADHGGGRPAAAGPLLKRSHSVPAPSIRKQILEELEKPGAGDPDPSAPQGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQVDGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 57159 - protein, 458 aa, Homo sapiens
MEEEKDDSPQADFCLGTALHSWGLWFTEEGSPSTMLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGRPAAAGPLLKRSHSVPAPSIRKQILEELEKPGAGDPDPSAPQARVLCLLPQCLGGLPPTDTSVYSSASSDCCGCSMPVLCIMGHKPHVTVDT

SEQ ID NO: 57160 - protein, 1254 aa, Homo sapiens
MEEEKDDSPQLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYEIMRKQPTVVLGVAHTVVKRMSSFVRQIDFALDWVEVEAGRAIYRQGDKSDCTYIMLSGRLRSVIRKDDGKKRLAGEYGRGDLVGVVETLTHQARATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQVDGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICVPDESDYQTEYEEELLDVPRDAYADFQSTSAQQGSDLEDESSLRHRHPSLAFPKLSEGSSDQDG

SEQ ID NO: 57161 - protein, 923 aa, Homo sapiens
MACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYEIMRKQPTVVLGVAHTVVKRMSSFVRQIDFALDWVEVEAGRAIYRQGDKSDCTYIMLSGRLRSVIRKDDGKKRLAGEYGRGDLVGVVETLTHQARATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQVDGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 57162 - protein, 1342 aa, Homo sapiens
MEEEKDDSPQADFCLGTALHSWGLWFTEEGSPSTMLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYEIMRKQPTVVLGVAHTVVKRMSSFVRQIDFALDWVEVEAGRAIYRQGDKSDCTYIMLSGRLRSVIRKDDGKKRLAGEYGRGDLVGVVETLTHQARATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQVDGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDLEDESSLRHRHPSLAFPKLSEGSSDQDG

SEQ ID NO: 57163 - protein, 1281 aa, Homo sapiens
MLTGIAVGALLALALVGVLILFMFRRLRQFRQAQPTPQYRFRKRDKVMFYGRKIMRKVTTLPNTLVENTALPRQRARKRTKVLSLAKRILRFKKEYPALQPKEPPPSLLEADLTEFDVKNSHLPSEVLYMLKNVRVLGHFEKPLFLELCKHIVFVQLQEGEHVFQPREPDPSICVVQDGRLEVCIQDTDGTEVVVKEVLAGDSVHSLLSILDIITGHAAPYKTVSVRAAIPSTILRLPAAAFHGVFEKYPETLVRVVQIIMVRLQRVTFLALHNYLGLTTELFNAESQAIPLVSVASVAAGKAKKQVFYGEEERLKKPPRLQESCDSDHGGGRPAAAGPLLKRSHSVPAPSIRKQILEELEKPGAGDPDPSAPQGGPGSATSDLGMACDRARVFLHSDEHPGSSVASKSRKSVMVAEIPSTVSQHSESHTDETLASRKSDAIFRAAKKDLLTLMKLEDSSLLDGRVALLHVPAGTVVSRQGDQDASILFVVSGLLHVYQRKIGSQEDTCLFLTRPGEMVGQLAVLTGEPLIFTVKANRDCSFLSISKAHFYEIMRKQPTVVLGVAHTVVKRMSSFVRQIDFALDWVEVEAGRAIYRQGDKSDCTYIMLSGRLRSVIRKDDGKKRLAGEYGRGDLVGVVETLTHQARATTVHAVRDSELAKLPAGALTSIKRRYPQVVTRLIHLLGEKILGSLQQGPVTGHQLGLPTEGSKWDLGNPAVNLSTVAVMPVSEEVPLTAFALELEHALSAIGPTLLLTSDNIKRRLGSAALDSVHEYRLSSWLGQQEDTHRIVLYQVDGTLTPWTQRCVRQADCILIVGLGDQEPTVGELERMLESTAVRAQKQLILLHREEGPAPARTVEWLNMRSWCSGHLHLCCPRRVFSRRSLPKLVEMYKHVFQRPPDRHSDFSRLARVLTGNAIALVLGGGGARGCAQVGVLKALAECGIPVDMVGGTSIGAFVGALYSEERNYSQMRIRAKQWAEGMTSLMKAALDLTYPITSMFSGAGFNSSIFSVFKDQQIEDLWIPYFAITTDITASAMRVHTDGSLWWYVRASMSLSGYMPPLCDPKDGHLLMDGGYINNLPADVARSMGAKVVIAIDVGSRDETDLTNYGDALSGWWLLWKRWNPLATKVKVLNMAEIQTRLAYVCCVRQLEVVKSSDYCEYLRPPIDSYSTLDFGKFNEICEVGYQHGRTVFDIWGRSGVLEKMLRDQQGPSKKPASAVLTCPNASFTDLAEIVSRIEPAKPAMVDDESDYQTEYEEELLDVPRDAYADFQSTSAQQGSDL

SEQ ID NO: 57164 - protein, 782 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 57165 - protein, 720 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVRKDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 57166 - protein, 55 aa, Homo sapiens
MSINLTVDIYIYLLSNARSVCGKQRSKQLYFLFSPKHYWRISHISLQRGFHTNII

SEQ ID NO: 57167 - protein, 782 aa, Homo sapiens; identical to SEQ ID NO: 57164

SEQ ID NO: 57168 - protein, 193 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYT

SEQ ID NO: 57169 - protein, 782 aa, Homo sapiens; identical to SEQ ID NO: 57164

SEQ ID NO: 57170 - protein, 717 aa, Homo sapiens
MSINLTVDIYIYLLSNARSVCGKQRSKQLYFLFSPKHYWRISHISLQRGFHTNIIRCKWTKSEAHSCSKHCYSPSNHGLHIGILKLSTSAPKGLTKVNICMSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 57171 - protein, 682 aa, Homo sapiens
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEEVHIMLDGLLPPDTYFRFNPVMCENIPLDESRNEKLDQLQLEGLKYIERNEQKMKKVAKILSQEKTTLQKINDWIKLKTDMYEGLPFFSKL

SEQ ID NO: 57172 - protein, 1203 aa, Homo sapiens
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRWGASSSLPQSFARVTTSMTVAIHPPPLPGAYIHPAPDEPPWSPAATSSGNLSSRGPGPATG

SEQ ID NO: 57173 - protein, 88 aa, Homo sapiens
  MOD_RES (1)..(1): Any amino acid
XFDFIVRYFFAALTVLTLLGLLHGLVLLPVLLSILGPPPEVIQMYKESPEILSPPAPQGGGLRVGSLQVNISYWKELLWCQDLRPEEI

SEQ ID NO: 57174 - protein, 1146 aa, Homo sapiens
MTRSPPLRELPPSYTPPARTAAPQILAGSLKAPLWLRAYFQGLLFSLGCGIQRHCGKVLFLGLLAFGALALGLRMAIIETNLEQLWVEVGSRVSQELHYTKEKLGEEAAYTSQMLIQTARQEGENILTPEALGLHLQAALTASKVQVSLYGKSWDLNKICYKSGVPLIENGMIERMIEKLFPCVILTPLDCFWEGAKLQGGSAYLPGRPDIQWTNLDPEQLLEELGPFASLEGFRELLDKAQVGQAYVGRPCLHPDDLHCPPSAPNHHSRQAPNVAHELSGGCHGFSHKFMHWQEELLLGGMARDPQGELLRAEALQSTFLLMSPRQLYEHFRGDYQTHDIGWSEEQASTVLQAWQRRFVQLAQEALPENASQQIHAFSSTTLDDILHAFSEVSAARVVGGYLLMLAYACVTMLRWDCAQSQGSVGLAGVLLVALAVASGLGLCALLGITFNAATTQVLPFLALGIGVDDVFLLAHAFTEALPGTPLQERMGECLQRTGTSVVLTSINNMAAFLMAALVPIPALRAFSLQAAIVVGCTFVAVMLVFPAILSLDLRRRHCQRLDVLCCFSSPCSAQVIQILPQELGDGTVPVGIAHLTATVQAFTHCEASSQHVVTILPPQAHLVPPPSDPLGSELFSPGGSTRDLLGQEEETRQKAACKSLPCARWNLAHFARYQFAPLLLQSHAKAIVLVLFGALLGLSLYGATLVQDGLALTDVVPRGTKEHAFLSAQLRYFSLYEVALVTQGGFDYAHSQRALFDLHQRFSSLKAVLPPPATQAPRTWLHYYRNWLQGIQAAFDQDWASGRITRHSYRNGSEDGALAYKLLIQTGDAQEPLDFSQLTTRKLVDREGLIPPELFYMGLTVWVSSDPLGLAASQANFYPPPPEWLHDKYDTTGENLRIPPAQPLEFAQFPFLLRGLQKTADFVEAIEGARAACAEAGQAGVHAYPSGSPFLFWEQYLGLRRCFLLAVCILLVCTFLVCALLLLNPWTAGLIVLVLAMMTVELFGIMGFLGIKLSAIPVVILVASVGIGVEFTVHVALGFLTTQGSRNLRAAHALEHTFAPVTDGAISTLLGLLMLAGSHFDFIVRYFFAALTVLTLLGLLHGLVLLPVLLSILGPPPEVIQMYKESPEILSPPAPQGGGLRPEEI

SEQ ID NO: 57175 - protein, 888 aa, Homo sapiens
MLRQVLHRGLRTCFSRLGHFIASHPVFFASAPVLISILLGASFSRYQVEESVEHLLAPQHSLAKIERNLVNSLFPVNRSKHRLYSDLQTPGRYGRVIVTSFQKANMLDQHHTDLILKLHAAVTKIQVPRPGFNYTFAHICILNNDKTCIVDDIVHVLEELKNARATNRTNFAITYPITHLKDGRAVYNGHQLGGVTVHSKDRVKSAEAIQLTYYLQSINSLNDMVAERWESSFCDTVRLFQKSNSKVKMYPYTSSSLREDFQKTSRVSERYLVTSLILVVTMAILCCSMQDCVRSKPWLGLLGLVTISLATLTAAGIINLTGGKYNSTFLGVPFVMLGHGLYGTFEMLSSWRKTREDQHVKERTAAVYADSMLSFSLTTAMYLVTFGIGASPFTNIEAARIFCCNSCIAIFFNYLYVLSFYGSSLVFTGYIENNYQHSIFCRKVPKPEALQEKPAWYRFLLTARFSEDTAEGEEANTYESHLLVCFLKRYYCDWITNTYVKPFVVLFYLIYISFALMGYLQVSEGSDLSNIVATATQTIEYTTAQQKYFSNYSPVIGFYIYESIEYWNTSVQEDVLEYTKGFVRISWFESYLNYLRKLNVSTGLPKKNFTDMLRNSFLKAPQFSHFQEDIIFSKKYNDEVDVVASRMFLVAKTMETNREELYDLLETLRRLSVTSKVKFIVFNPSFVYMDRYASSLGAPLHNSCISALFLLFFSAFLVADSLINVWITLTVVSVEFGVIGFMTLWKVELDCISVLCLIYGINYTIDNCAPMLSTFVLGKDFTRTKWVKNALEVHGVAILQSYLCYIVGLIPLAAVPSNLTCTLFRCLFLIAFVTFFHCFAILPVILTFLPPSKKKRKEKKNPENREEIECVEMVDIDSTRVVDQITTV

SEQ ID NO: 57176 - protein, 1392 aa, Homo sapiens
MDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGGPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVGLFVSILILSLVFASRLRPASRAPLLFRPDTNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTRKLYFAQSHKPPFHGRVCMAPPGCLLSSSPDGPTKGFFFVPSEKVPKARLSATFGFNPCVNTGCGKPAVRPLVDTGAMVFVVFGIIGVNRTRQVDNHVIGDPGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIVGVQSALCGLVLSLLICVAAVAVFTTHILLLLPVLLSILGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 57177 - protein, 1392 aa, Homo sapiens
MDTEDDPLLQDVWLEEEQEEEEATGETFLGAQKPGPQPGAGGQCCWRHWPLASRPPASGFWSTLGWAFTNPCCAGLVLFLGCSIPMALSAFMFLYYPPLDIDISYNAFEIRNHEASQRFDALTLALKSQFGSWGRNRRDLADFTSETLQRLISEQLQQLHLGNRSRQASRAPRVIPAASLGGPGPYRDTSAAQKPTANRSGRLRRETPPLEDLAANQSEDPRNQRLSKNGRYQPSIPPHAAVAANQSRARRGASRWDYSRAYVSANTQTHAHWRIELIFLARGDAERNIFTSERLVTIHEIERKIMDHPGFREFCWKPHEVLKDLPLGSYSYCSPPSSLMTYFFPTERGGKIYYDGMGQDLADIRGSLELAMTHPEFYWYVDEGLSADNLKSSLLRSEILFGAPLPNYYSVDDRWEEQRAKFQSFVVTYVAMLAKQSTSKVQVLYGGTDLFDYEVRRTFNNDMLLAFISSSCIAALVYILTSCSVFLSFFGIASIGLSCLVALFLYHVVFGIQYLGILNGVAAFVIVGIGVDDVFVFINTYRQATHLEDPQLRMIHTVQTAGKATFFTSLTTAAAYAANVFSQIPAVHDFGLFMSLIVSCCWLAVLVTMPAALGLWSLYLAPLESSCQTSCHQNCSRKTSLHFPGDVFAAPEQVGGSPAQGPIPYLDDDIPLLEVEEEPVSLELGDVSLVSVSPEGLQPASNTGSRGHLIVQLQELLHHWVLWSAVKSRWVIVGLFVSILILSLVFASRLRPASRAPLLFRPDTNIQVLLDLKYNLSAEGISCITCSGLFQEKPHSLQNNIRTSLEKKRRGSGVPWASRPEATLQDFPGTVYISKVKSQGHPAVYRLSLNASLPAPWQAVSPGDGEVPSFQVYRAPFGNFTKKLTACMSTVGLLQAASPSRKWMLTTLACDAKRGWKFDFSFYVATKEQQHTRKLYFAQSHKPPFHGRVCMAPPGCLLSSSPDGPTKGFFFVPSEKVPKARLSATFGFNPCVNTGCGKPAVRPLVDTGAMVFVVFGIIGVNRTRQVDNHVIGDPGSVVYDSSFDLFKEIGHLCHLCKAIAANSELVKPGGAQCLPSGYSISSFLQMLHPECKELPEPNLLPGQLSHGAVGVREGRVQWISMAFESTTYKGKSSFQTYSDYLRWESFLQQQLQALPEGSVLRRGFQTCEHWKQIFMEIAGVQSALCGLVLSLLICVAAVAVFTTHILLLLPVLLSILGIVCLVVTIMYWSGWEMGAVEAISLSILVGSSVDYCVHLVEGYLLAGENLPPHQAEDARTQRQWRTLEAVRHVGVAIVSSALTTVIATVPLFFCIIAPFAKFGKIVALNTGVSILYTLTVSTALLGIMAPSSFTRTRTSFLKALGAVLLAGALGLGACLVLLQSGYKIPLPAGASL

SEQ ID NO: 57178 - protein, 767 aa, Homo sapiens
MPWVEPKPRPGPEQKPKLTKPDSATGPQWYQESQESESEGKQPPPGPLAPPKSPEPSGPLASEQDAPLPEGDDAPPRPSMLDDAPRLPLELDDAPLPEEETPEPTAICRHRHRCHTDCLEGLLSRTFQWLGWQVGAHPWIFLLAPLMLTAALGTGFLYLPKDEEEDLEEHYTPVGSPAKAERRFVQGHFTTNDSYRFSASRRSTEANFVSLLVVSYSDSLLDPATFAEVSKLDGAVQDLRVAREKGSQIQYQQVCARYRALCVPPNPILYAWQVNKTLNLSSISFPAYNHGRHPLYLTGFFGGYILGGSLGMGQLLLRAKAMRLLYYLKTEDPEYDVQSKQWLTHLLDQFTNIKNILALKKIEVVHFTSLSRQLEFEATSVTVIPVFHLAYILIILFAVTSCFRFDCIRNKMCVAAFGVISAFLAVVSGFGLLLHIGVPFVIIVANSPFLILGVGVDDMFIMISAWHKTNLADDIRERMSNVYSKAAVSITITTITNILALYTGIMSSFRSVQCFCIYTGMTLLFCYFYNITCFGAFMALDGKREVVCLCWLKKADPKWPSFKKFCCFPFGSVPDEHGTDIHPISLFFRDYFGPFLTRSESKYFVVFIYVLYIISSIYGCFHVQEGLDLRNLASDDSYITPYFNVEENYFSDYGPRVMVIVTKKVDYWDKDVRQKLENCTKIFEKNVYVDKNLTEFWLDAYVQYLKGNSQDPNEKNTFMNNIPDFLSNFPNFQHDINISSSNEIISSRGFIQTTDVSSSAKKKILLF

SEQ ID NO: 57179 - protein, 325 aa, Homo sapiens
MTERRRDELSEEINNLREKVMKQSEENNNLQSQVQKLTEENTTLREQVEPTPEDEDDDIELRGAAAAAAPPPPIEEECPEDLPEKFDGNPDMLAPFMAQCQIFMEKSTRDFSVDRVRVCFVTSMMTGRAARWASAKLERSHYLMHNYPAFMMEMKHVFEDPQRREVAKRKIRRLRQGMGSVIDYSNAFQMIAQDLDWNEPALIDQYHEGLSDHIQEELSHLEVAKSLSALIGQCIHIERRLARAAAARKPRSPPRALVLPHIASHHQVDPTEPVGGARMRLTQEEKERRRKLNLCLYCGTGGHYADNCPAKASKSSPAGNSPAPL

SEQ ID NO: 57180 - protein, 325 aa, Homo sapiens; identical to SEQ ID NO: 57179

SEQ ID NO: 57181 - protein, 436 aa, Homo sapiens
MMATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 57182 - protein, 319 aa, Homo sapiens
MVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGAVVTITTPVNMNVDSLQSLSSDGATLAVQQVMMAGQSEDESVDSTEEDAGALAPAHISGLVLENSDSLQ

SEQ ID NO: 57183 - protein, 419 aa, Homo sapiens
MMATQTLSIDSYQDGQQMQVVTELKTEQDPNCSEPDAEGVSPPPVESQTPMDVDKQAIYRHPLFPLLALLFEKCEQSTQGSEGTTSASFDVDIENFVRKQEKEGKPFFCEDPETDNLMVKAIQVLRIHLLELEKVNELCKDFCSRYIACLKTKMNSETLLSGEPGSPYSPVQSQQIQSAITGTISPQGIVVPASALQQGNVAMATVAGGTVYQPVTVVTPQGQVVTQTLSPGTIRIQNSQLQLQLNQDLSILHQDDGSSKNKRGVLPKHATNVMRSWLFQHIGHPYPTEDEKKQIAAQTNLTLLQVNNWFINARRRILQPMLDSSCSETPKTKKKTAQNRPVQRFWPDSIASGVAQPPPSELTMSEGTGGRPRPDMVDHGVGIMNKRPGSGLLAPPRPAENDILKPPLRSSFVNCLLIF

SEQ ID NO: 57184 - protein, 472 aa, Homo sapiens
MMQHASPAPALTMMATQNVPPPPYQDSPQMTATAQPPSKAQAVHISAPSAAASTPVPSAPIDPQAQLEADKRAVYRHPLFPLLTLLFEKCEQATQGSECITSASFDVDIENFVHQQEQEHKPFFSDDPELDNLMVKAIQVLRIHLLELEKVNELCKDFCNRYITCLKTKMHSDNLLRNDLGGPYSPNQPSINLHSQDLLQNSPNSMSGVSNNPQGIVVPASALQQGNIAMTTVNSQVVSGGALYQPVTMVTSQGQVVTQAIPQGAIQIQNTQVNLDLTSLLDNEDKKSKNKRGVLPKHATNIMRSWLFQHLMHPYPTEDEKRQIAAQTNLTLLQVNNWFINARRRILQPMLDASNPDPAPKAKKIKSQHRPTQRFWPNSIAAGVLQQQGGAPGTNPDGSINLDNLQSLSSDSATMAMQQAMMAAHDDSLDGTEEEDEDEMEEEEEEELEEEVDELQTTNVSDLGLEHSDSLE

SEQ ID NO: 57185 - protein, 39 aa, Homo sapiens
MMQHASPAPALTMMATQNVPPPPYQDSPQMTATAQPPSK

SEQ ID NO: 57186 - protein, 443 aa, Homo sapiens
MTATAQPPSKAQAVHISAPSAAASTPVPSAPIDPQAQLEADKRAVYRHPLFPLLTLLFEKCEQATQGSECITSASFDVDIENFVHQQEQEHKPFFSDDPELDNLMVKAIQVLRIHLLELEKVNELCKDFCNRYITCLKTKMHSDNLLRNDLGGPYSPNQPSINLHSQDLLQNSPNSMSGVSNNPQGIVVPASALQQGNIAMTTVNSQVVSGGALYQPVTMVTSQGQVVTQAIPQGAIQIQNTQVNLDLTSLLDNEDKKSKNKRGVLPKHATNIMRSWLFQHLMHPYPTEDEKRQIAAQTNLTLLQVNNWFINARRRILQPMLDASNPDPAPKAKKIKSQHRPTQRFWPNSIAAGVLQQQGGAPGTNPDGSINLDNLQSLSSDSATMAMQQAMMAAHDDSLDGTEEEDEDEMEEEEEEELEEEVDELQTTNVSDLGLEHSDSLE

SEQ ID NO: 57187 - protein, 443 aa, Homo sapiens; identical to SEQ ID NO: 57186

SEQ ID NO: 57188 - protein, 40 aa, Homo sapiens
MMQHASPAPALTMMATQNVPPPPYQDSPQMTATAQPPSKA

SEQ ID NO: 57189 - protein, 306 aa, Homo sapiens
MMATQNVPPPPYQDSPQMTATAQPPSKAQAVHISAPSAAASTPVPSAPIDPQAQLEADKRAVYRHPLFPLLTLLFEKCEQATQGSECITSASFDVDIENFVHQQEQEHKPFFSDDPELDNLMVKAIQVLRIHLLELEKVNELCKDFCNRYITCLKTKMHSDNLLRNDLGGPYSPNQPSINLHSQDLLQNSPNSMSGVSNNPQGIVVPASALQQGNIAMTTVNSQVVSGGALYQPVTMVTSQGQVVTQAIPQGAIQIQNTQVNLDLTSLLDNEDKKSKNKRGVLPKHATNIMRSWLFQHHAPLPHGG

SEQ ID NO: 57190 - protein, 408 aa, Homo sapiens
MSRPHPTRTAHRHPLFPLLTLLFEKCEQATQGSECITSASFDVDIENFVHQQEQEHKPFFSDDPELDNLMVKAIQVLRIHLLELEKVNELCKDFCNRYITCLKTKMHSDNLLRNDLGGPYSPNQPSINLHSQDLLQNSPNSMSGVSNNPQGIVVPASALQQGNIAMTTVNSQVVSGGALYQPVTMVTSQGQVVTQAIPQGAIQIQNTQVNLDLTSLLDNEDKKSKNKRGVLPKHATNIMRSWLFQHLMHPYPTEDEKRQIAAQTNLTLLQVNNWFINARRRILQPMLDASNPDPAPKAKKIKSQHRPTQRFWPNSIAAGVLQQQGGAPGTNPDGSINLDNLQSLSSDSATMAMQQAMMAAHDDSLDGTEEEDEDEMEEEEEEELEEEVDELQTTNVSDLGLEHSDSLE

SEQ ID NO: 57191 - protein, 98 aa, Homo sapiens
MMQHASPAPALTMMATQNVPPPPYQDSPQMTATAQPPSKAQAVHISAPSAAASTPVPSAPIDPQAQLEADKRAVYRHPLFPLLTLLFEKCEQATQGSE

SEQ ID NO: 57192 - protein, 77 aa, Homo sapiens
MMQHASPAPALTMMATQNVPPPPYQDSPQMTATAQPPSKAQAVHISAPSAAASTPVPSAPIDPQAQLEADKRAVYRW

SEQ ID NO: 57193 - protein, 329 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHFAL

SEQ ID NO: 57194 - protein, 333 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEHQTTCNLQ

SEQ ID NO: 57195 - protein, 530 aa, Homo sapiens
MTRDFKPGDLIFAKMKGYPHWPARVDEVPDGAVKPPTNKLPIFFFGTHETAFLGPKDIFPYSENKEKYGKPNKRKGFNEGLWEIDNNPKVKFSSQQAATKQSNASSDVEVEEKETSVSKEDTDHEEKASNEDVTKAVDITTPKAARRGRKRKAEKQVETEEAGVVTTATASVNLKVSPKRGRPAATEVKIPKPRGRPKMVKQPCPSESDIITEEDKSKKKGQEEKQPKKQPKKDEEGQKEEDKPRKEPDKKEGKKEVESKRKNLAKTGVTSTSDSEEEGDDQEGEKKRKGGRNFQTAHRRNMLKGQHEKEAADRKRKQEEQMETEQQNKDEGKKPEVKKVEKKRETSMDSRLQRIHAEIKNSLKIDNLDVNRCIEALDELASLQVTMQQAQKHTEMITTLKKIRRFKVSQVIMEKSTMLYNKFKNMFLVGEGDSVITQVLNKSLAEQRQHEEANKTKDQGKKGPNKKLEKEQTGSKTLNGGSDAQDGNQPQHNGESNEDSKDNHEASTKKKPSSEERETEISLKDSTLDN

SEQ ID NO: 57196 - protein, 530 aa, Homo sapiens; identical to SEQ ID NO: 57195

SEQ ID NO: 57197 - protein, 333 aa, Homo sapiens; identical to SEQ ID NO: 57194

SEQ ID NO: 57198 - protein, 453 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQYPLSFMAAVPHRTHAVDYLGLETRKHWASCSFLQLERNDSVLEQKLVSALSLGTSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 57199 - protein, 399 aa, Homo sapiens
MRLTDVVQQLVYEAIDSRDGASCAELVSFKHPHVANPRLQMASPEEKCQQVLEPPYDEMFAAHLRCTYAVGNHDFIEAYKCQTVIVQYTSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 57200 - protein, 399 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 57201 - protein, 376 aa, Homo sapiens
MAHITINQYLQQVYEAIDSRDGASCAELVSFKHPHVANPRLQMASPEEKCQQVLEPPYDEMFAAHLRCTYAVGNHDFIEAYKCQTVIVQYPLSFMAAVADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 57202 - protein, 399 aa, Homo sapiens; identical to SEQ ID NO: 57200

SEQ ID NO: 57203 - protein, 399 aa, Homo sapiens; identical to SEQ ID NO: 57200

SEQ ID NO: 57204 - protein, 397 aa, Homo sapiens
MRLTDVVQQLVYEAIDSRDGASCAELVSFKHPHVANPRLQMASPEEKCQQVLEPPYDEMFAAHLRCTYAVGNHDFIEAYKCQTVIVQSFLRAFQAHKEENWALPVMYAVALDLRVFANNADQQLVKKGKSKVGDMLEKAAELLMSCFRVCASDTRAGIEDSKKWGMLFLVNQLFKIYFKINKLHLCKPLIRAIDSSNLKDDYSTAQRVTYKYYVGRKAMFDSDFKQAEEYLSFAFEHCHRSSQKNKRMILIYLLPVKMLLGHMPTVELLKKYHLMQFAEVTRAVSEGNLLLLHEALAKHEAFFIRCGIFLILEKLKIITYRNLFKKVYLLLKTHQLSLDAFLVALKFMQVEDVDIDEVQCILANLIYMGHVKGYISHQHQKLVVSKQNPFPPLSTVC

SEQ ID NO: 57205 - protein, 181 aa, Homo sapiens
MPKGGRKGGHKGRARQYTSPEEIDAQLQAEKQKAREEEEQKEGGDGAAGDPKKEKKSLDSDESEDEEDDYQQKRKGVEGLIDIENPNRVAQTTKKVTQLDLDGPKELSRREREEIEKQKAKERYMKMHLAGKTEQAKADLARLAIIRKQREEAARKKEEERKAKDDATLSGKRMQSLSLNK

SEQ ID NO: 57206 - protein, 341 aa, Homo sapiens
MVSSQPKYDLIREVGRGSYGVVYEAVIRKTSARVAVKKIRCHAPENVELALREFWALSSIKSQHPNVIHLEECILQKDGMVQKMSHGSNSSLYLQLVETSLKGEIAFDPRSAYYLWFVMDFCDGGDMNEYLLSRKPNRKTNTSFMLQLSSALAFLHKNQIIHRDLKPDNILISQTRLDTSDLEPTLKVADFGLSKVCSASGQNPEEPVSVNKCFLSTACGTDFYMAPEVWEGHYTAKADIFALGIIIWAMLERITFIDTETKKELLGSYVKQGTEIVPVGEALLENPKMELLIPVKKKSMNGRMKQLIKEMLAANPQDRPDAFELELRLVQIAFKDSSWET

SEQ ID NO: 57207 - protein, 341 aa, Homo sapiens; identical to SEQ ID NO: 57206

SEQ ID NO: 57208 - protein, 191 aa, Homo sapiens
MVSSQPKYDLIREVGRGSYGVVYEAVIRKTSARVAVKKIRCHAPENVELALREFWALSSIKSQHPNVIHLEECILQKDGMVQKMSHGSNSSLYLQLVETSLKGEIAFDPRSAYYLWFVMDFCDGGDMNEYLLSRKPNRKTNTSFMLQLSSALAFLHKNQIIHRDLKPDNILISQTRLDTSDLEPTLKVADF

SEQ ID NO: 57209 - protein, 1337 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVREIARKLANPKQPTNPFLEMVKFLLERIAPVHIDSEAISALVKLMNKSIEGTADDEEEGVSPDTAIRSGLELLKVLSFTHPTSFHSAETYESLLQCLRMEDDKVAEAAIQIFRNTGHKIETDLPQIRSTLIPILHQKAKRGTPHQAKQAVHCIHAIFTNKEVQLAQIFEPLSRSLNADVPEQLITPLVSLGHISMLAPDQFASPMKSVVANFIVKDLLMNDRSTGEKNGKLWSPDEEVSPEVLAKVQAIKLLVRWLLGMKNNQSKSANSTLRLLSAMLVSEGDLTEQKRISKSDMSRLRLAAGSAIMKLAQEPCYHEIITPEQFQLCALVINDECYQVRQIFAQKLHKALVKLLLPLEYMAIFALCAKDPVKERRAHARQCLLKNISIRREYIKQNPMATEKLLSLLPEYVVPYMIHLLAHDPDFTRSQDVDQLRDIKECLWFMLEVLMTKNENNSHAFMKKMAENIKLTRDAQSPDESKTNEKLYTVCDVALCVINSKSALCNADSPKDPVLPMKFFTQPEKDFCNDKSYISEETRVLLLTGKPKPAGVLGAVNKPLSATGRKPYVRSTGTETGSNINVNSELNPSTGNRSREQSSEAAETGVSENEENPVRIISVTPVKNIDPVKNKEINSDQATQGNISSDRGKKRTVTAAGAENIQQKTDEKVDESGPPAPSKPRRGRRPKSESQGNATKNDDLNKPINKGRKRAAVGQESPGGLEAGNAKAPKLQDLAKKAAPAERQIDLQR

SEQ ID NO: 57210 - protein, 600 aa, Homo sapiens
MDFTAQPKPATALCGVVSADGKIAYPPGVKEITDKITTDEMIKRLKMVVKTFMDMDQDSEDEKQQYLPLALHLASEFFLRNPNKDVRLLVACCLADIFRIYAPEAPYTSHDKLKDIFLFITRQLKGLEDTKSPQFNRYFYLLENLAWVKSYNICFELEDCNEIFIQLFRTLFSVINNSHNKKVQMHMLDLMSSIIMEGDGVTQELLDSILINLIPAHKNLNKQSFDLAKVLLKRTVQTIEACIANFFNQVLVLGRSSVSDLSEHVFDLIQELFAIDPHLLLSVMPQLEFKLKSNDGEERLAVVRLLAKLFGSKDSDLATQNRPLWQCFLGRFNDIHVPVRLESVKFASHCLMNHPDLAKDLTEYLKVRSHDPEEAIRHDVIVTIITAAKRDLALVNDQLLGFVRERTLDKRWRVRKEAMMGLAQLYKKYCLHGEAGKEAAEKVSWIKDKLLHIYYQNSIDDKLLVEKIFAQYLVPHNLETEERMKCLYYLYASLDPNAVKALNEMWKCQNMLRSHVRELLDLHKQPTSEANCSAMFGKLMTIAKNLPDPGKAQDFVKKFNQVLGDDEKLRSQLELLISPTCSCKQADICVVSKSYFTLFL

SEQ ID NO: 57211 - protein, 329 aa, Homo sapiens
MTTQQIDLQGPGPWGFRLVGGKDFEQPLAISRVTPGSKAALANLCIGDVITAIDGENTSNMTHLEAQNRIKGCTDNLTLTVARSEHKVWSPLVTEEGKRHPYKMNLASEPQEVLHIGSAHNRSAMPFTASPASSTTARVITNQYNNPAGLYSSENISNFNNALESKTAASGVEANSRPLDHAQPPSSLVIDKESEVYKMLQEKQELNEPPKQSTSFLVLQEILESEEKGDPNKPSGFRSVKAPVTKVAASIGNAQKLPMCDKCGTGIVGVFVKLRDRHRHPECYVCTDCGTNLKQKGHFFVEDQIYCEKHARERVTPPEGYEVVTVFPK

SEQ ID NO: 57212 - protein, 366 aa, Homo sapiens
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWEDACAMEGMRLSLEALEGMVEGAKRRDRRKTRRPIQPSW

SEQ ID NO: 57213 - protein, 602 aa, Homo sapiens
MRGGRARPAWESFMGLPPRSSAKWGAGQSLDRLCCAPGSRGLAGAPGRMRAPPAGRSQPAGGPGDSLPHPPGGLGPGGSAWARRAEAAASRARGGGRGGPGITWAEAGPGAPGGLSPESGRRQRERWRLPAFPPSRAWAPSRTGERQPGERAHLRLSARPALPGAGLLSAPLSARNPGLVRGPAPWSLASAGAPPRAALSPAGALLLQPPARRVLCPRSEGGSRTGRAGPSGWAPPRGARSAESTDRLKGMALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWVGDELYCEKHARQRYSAPATLSSRA

SEQ ID NO: 57214 - protein, 278 aa, Homo sapiens
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGTRLCASRRAGTATPAATPVPTVG

SEQ ID NO: 57215 - protein, 224 aa, Homo sapiens
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSRPRPRWRLGGAGAAAFPGPSFLQAQHGLGRGKPPPGRGLGSLQDAAGKSRGTGGPPTVQLLSALAGSPGG

SEQ ID NO: 57216 - protein, 352 aa, Homo sapiens
MALTVDVAGPAPWGFRITGGRDFHTPIMVTKVAERGKAKDADLRPGDIIVAINGESAEGMLHAEAQSKIRQSPSPLRLQLDRSQATSPGQTNGDSSLEVLATRFQGSVRTYTESQSSLRSSYSSPTSLSPRAGSPFSPPPSSSSLTGEAAISRSFQSLACSPGLPAADRLSYSGRPGSRQAGLGRAGDSAVLVLPPSPGPRSSRPSMDSEGGSLLLDEDSEVFKMLQENREGRAAPRQSSSFRLLQEALEAEERGGTPAFLPSSLSPQSSLPASRALATPPKLHTCEKCSTSIANQAVRIQEGRYRHPGCYTCADCGLNLKMRGHFWVGDELYCEKHARQRYSAPATLSSRA

SEQ ID NO: 57217 - protein, 352 aa, Homo sapiens; identical to SEQ ID NO: 57216

SEQ ID NO: 57218 - protein, 278 aa, Homo sapiens; identical to SEQ ID NO: 57214

SEQ ID NO: 57219 - protein, 352 aa, Homo sapiens; identical to SEQ ID NO: 57216

SEQ ID NO: 57220 - protein, 519 aa, Homo sapiens
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQKGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 57221 - protein, 519 aa, Homo sapiens; identical to SEQ ID NO: 57220

SEQ ID NO: 57222 - protein, 264 aa, Homo sapiens
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGKKGVYMTDITPQGVAMRAGVLADDHLIEVNGENVEDASHEEVVEKVKKSGSRVMFLLVDKETDKRHVEQKIQFKRETASLKLLPHQPRIVEMKKGSNGYGFYLRAGSEQK

SEQ ID NO: 57223 - protein, 408 aa, Homo sapiens
MTSTFNPRECKLSKQEGQNYGFFLRIEKDTEGHLVRVVEKCSPAEKAGLQDGDRVLRINGVFVDKEEHMQVVDLVRKSGNSVTLLVLDGDSYEKAVKTRVDLKELGQSQKEQGLSDNILSPVMNGGVQTWTQPRLCYLVKEGGSYGFSLKTVQGQIIKDIDSGSPAEEAGLKNNDLVVAVNGESVETLDHDSVVEMIRKGGDQTSLLVVDKETDNMYRLAHFSPFLYYQSQELPNGSVKEAPAPTPTSLEVSSPPDTTEEVDHKPKLCRLAKGENGYGFHLNAIRGLPGSFIKEVQKGGPADLAGLEDEDVIIEVNGVNVLDEPYEKVVDRIQSSGKNVTLLVCGKKAYDYFQAKKIPIVSSLADPLDTPPDSKEGIVVESNHDSHMAKERAHSTASHSSSNSEDTEM

SEQ ID NO: 57224 - protein, 140 aa, Homo sapiens
MDSRIPYDDYPVVFLPAYENPPAWIPPHERVHHPDYNNELTQFLPRTITLKKPPGAQLGFNIRGGKASQLGIFISKVIPDSDAHRAGLQEGDQVLAVNDVDFQDIEHSKAVEILKTAREISMRVRFFPYNYHRQKERTVH

SEQ ID NO: 57225 - protein, 140 aa, Homo sapiens; identical to SEQ ID NO: 57224

SEQ ID NO: 57226 - protein, 2839 aa, Homo sapiens
MPITQDNAVLHLPLLYQWLQNSLQEGGDGPEQRLCQAAIQKLQEYIQLNFAVDESTVPPDHSPPEMEICTVYLTKELGDTETVGLSFGNIPVFGDYGEKRRGGKKRKTHQGPVLDVGCIWVTELRKNSPAGKSGKVRLRDEILSLNGQLMVGVDVSGASYLAEQCWNGGFIYLIMLRRFKHKAHSTYNGNSSNSSEPGETPTLELGDRTAKKGKRTRKFGVISRPPANKAPEESKGSAGCEVSSDPSTELENGPDPELGNGHVFQLENGPDSLKEVAGPHLERSEVDRGTEHRIPKTDAPLTTSNDKRRFSKGGKTDFQSSDCLAREEVGRIWKMELLKESDGLGIQVSGGRGSKRSPHAIVVTQVKEGGAAHRDGRLSLGDELLVINGHLLVGLSHEEAVAILRSATGMVQLVVASKENSAEDLLRLTSKSLPDLTSSVEDVSSWTDNEDQEADGEEDEGTSSSVQRAMPGTDEPQDVCGAEESKGNLESPKQGSNKIKLKSRLSGGVHRLESVEEYNELMVRNGDPRIRMLEVSRDGRKHSLPQLLDSSSASQEYHIVKKSTRSLSTTQVESPWRLIRPSVISIIGLYKEKGKGLGFSIAGGRDCIRGQMGIFVKTIFPNGSAAEDGRLKEGDEILDVNGIPIKGLTFQEAIHTFKQIRSGLFVLTVRTKLVSPSLTPCSTPTHMSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPPGPVRLVIGRHPNPKVSEQEMDEVIARSTYQESKEANSSPGLGTPLKSPSLAKKDSLISESELSQYFAHDVPGPLSDFMVAGSEDEDHPGSGCSTSEEGSLPPSTSTHKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKESLGKLTTGDACVSTSCELASALSHLDASHLTENLPKAASELGQQPMTELDSSSDLISSPGKKGAAHPDPSKTSVDTGQVSRPENPSQPASPRVTKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEEDVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 57227 - protein, 2640 aa, Homo sapiens
MPITQDNAVLHLPLLYQWLQNSLQEGGDGPEQRLCQAAIQKLQEYIQLNFAVDESTVPPDHSPPEMEICTVYLTKELGDTETVGLSFGNIPVFGDYGEKRRGGKKRKTHQGPVLDVGCIWVTELRKNSPAGKSGKVRLRDEILSLNGQLMVGVDVSGASYLAEQCWNGGFIYLIMLRRFKHKAHSTYNGNSSNSSEPGETPTLELGDRTAKKGKRTRKFGVISRPPANKAPEESKGSAGCEVSSDPSTELENGPDPELGNGHVFQLENGPDSLKEVAGPHLERSEVDRGTEHRIPKTDAPLTTSNDKRRFSKGGKTDFQSSDCLAREEVGRIWKMELLKESDGLGIQVSGGRGSKRSPHAIVVTQVKEGGAAHREYHIVKKSTRSLSTTQVESPWRLIRPSVISIIGLYKEKGKGLGFSIAGGRDCIRGQMGIFVKTIFPNGSAAEDGRLKEGDEILDVNGIPIKGLTFQEAIHTFKQIRSGLFVLTVRTKLVSPSLTPCSTPTHMSRSASPNFNTSGGASAGGSDEGSSSSLGRKTPGPKDRIVMEVTLNKEPRVGLGIGACCLALENSPPGIYIHSLAPGSVAKMESNLSRGDQILEVNSVNVRHAALSKVHAILSKCPVSEQEMDEVIARSTYQESKEANSSPGLGTPLKSPSLAKKDSLISESELSQYFAHDVPGPLSDFMVAGSEDEDHPGSGCSTSEEGSLPPSTSKEPGKPRANSLVTLGSHRASGLFHKQVTVARQASLPGSPQALRNPLLRQRKVGCYDANDASDEEEFDREGDCISLPGALPGPIRPLSEDDPRRVSISSSKGMDVHNQEERPRKTLVSKAISAPLLGSSVDLEESIPEGMVDAASYAANLTDSAEAPKGSPGSWWKKELSGSSSAPKLEYTVRTDTQSPTNTGSPSSPQQKSEGLGSRHRPVARVSPHCKRSEAEAKPSGSQTVNLTGRANDPCDLDSRVQATSVKVTVAGFQPGGAVEKLCQESLGKLTTGDACVSTSCELASALSHLDASHLTENLPKAASELGQQPMTASDLISSPGKKGAAHPDPSKTSVDTGQVSRPENPSQPASPRVTKCKARSPVRLPHEGSPSPGEKAAAPPDYSKTRSASETSTPHNTRRVAALRGAGPGAEGMTPAGAVLPGDPLTSQEQRQGAPGNHSKALEMTGIHAPESSQEPSLLEGADSVSSRAPQASLSMLPSTDNTKEACGHVSGHCCPGGSRESPVTDIDSFIKELDASAARSPSSQTGDSGSQEGSAQGHPPAGAGGGSSCRAEPVPGGQTSSPRRAWAAGAPAYPQWASQPSVLDSINPDKHFTVNKNFLSNYSRNFSSFHEDSTSLSGLGDSTEPSLSSMYGDAEDSSSDPESLTEAPRASARDGWSPPRSRVSLHKEDPSESEEEQIEICSTRGCPNPPSSPAHLPTQAAICPASAKVLSLKYSTPRESVASPREKAACLPGSYTSGPDSSQPSSLLEMSSQEHETHADISTSQNHRPSCAEETTEVTSASSAMENSPLSKVARHFHSPPIILSSPNMVNGLEHDLLDDETLNQYETSINAAASLSSFSVDVPKNGESVLENLHISESQDLDDLLQKPKMIARRPIMAWFKEINKHNQGTHLRSKTEKEQPLMPARSPDSKIQMVSSSQKKGVTVPHSPPQPKTNLENKDLSKKSPAEMLLTNGQKAKCGPKLKRLSLKGKAKVNSEAPAANAVKAGGTDHRKPLISPQTSHKTLSKAVSQRLHVADHEDPDRNTTAAPRSPQCVLESKPPLATSGPLKPSVSDTSIRTFVSPLTSPKPVPEQGMWSRFHMAVLSEPDRGCPTTPKSPKCRAEGRAPRADSGPVSPAASRNGMSVAGNRQSEPRLASHVAADTAQPRPTGEKGGNIMASDRLERTNQLKIVEISAEAVSETVCGNKPAESDRRGGCLAQGNCQEKSEIRLYRQVAESSTSHPSSLPSHASQAEQEMSRSFSMAKLASSSSSLQTAIRKAEYSQGKSSLMSDSRGVPRNSIPGGPSGEDHLYFTPRPATRTYSMPAQFSSHFGREGHPPHSLGRSRDSQVPVTSSVVPEAKASRGGLPSLANGQGIYSVKPLLDTSRNLPATDEGDIISVQETSCLVTDKIKVTRRHYCYEQNWPHESTSFFSVKQRIKSFENLANADRPVAKSGASPFLSVSSKPPIGRRSSGSIVSGSLGHPGDAAARLLRRSLSSCSENQSEAGTLLPQMAKSPSIMTLTISRQNPPETSSKGSDSELKKSLGPLGIPTPTMTLASPVKRNKSSVRHTQPSPVSRSKLQELRALSMPDLDKLCSEDYSAGPSAVLFKTELEITPRRSPGPPAGGVSCPEKGGNRACPGGSGPKTSAAETPSSASDTGEAAQDLPFRRSWSVNLDQLLVSAGDQQRLQSVLSSVGSKSTILTLIQEAKAQSENEEDVCFIVLNRKEGSGLGFSVAGGTDVEPKSITVHRVFSQGAASQEGTMNRGDFLLSVNGASLAGLAHGNVLKVLHQAQLHKDALVVIKKGMDQPRPSARQEPPTANGKGLLSRKTIPLEPGIGRSVAVHDALCVEVLKTSAGLGLSLDGGKSSVTGDGPLVIKRVYKGGAAEQAGIIEAGDEILAINGKPLVGLMHFDAWNIMKSVPEGPVQLLIRKHRNSS

SEQ ID NO: 57228 - protein, 2839 aa, Homo sapiens; identical to SEQ ID NO: 57226

SEQ ID NO: 57229 - protein, 14 aa, Homo sapiens
MPITQDNAVLHLPL

SEQ ID NO: 57230 - protein, 491 aa, Homo sapiens
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 57231 - protein, 505 aa, Homo sapiens
MEKAADLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 57232 - protein, 571 aa, Homo sapiens
MVTPSPPGNHSLSLEAPRLHTASDLLGNHSLGLPLITALVGSRDRRGRVFSPVPVPLPTNPTTQHPTRQKLPSTLSGHRVCQAHGEPVLGLCPLLPLFCCPPHPPDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 57233 - protein, 505 aa, Homo sapiens
MEEALDLQDTASLTLKFKFNPKLGIDNPVLSLAEDHDPYDPWSLERPRFCLLSKEEGKSFGFHLQQELGRAGHVVCRVDPGTSAQRQGLQEGDRILAVNNDVVEHEDYAVVVRRIRASSPRVLLTVLARHAHDVARAQLGEDAHLCPTLGPGVRPRLCHIVKDEGGFGFSVTHGNQGPFWLVLSTGGAAERAGVPPGARLLEVNGVSVEKFTHNQLTRKLWQSGQQVTLLVAGPEVEEQCRQLGLPLAAPLAEGWALPTKPRCLHLEKGPQGFGFLLREEKGLDGRPGQFLWEVDPGLPAKKAGMQAGDRLVAVAGESVEGLGHEETVSRIQGQGSCVSLTVVDPEADRFFSMVRLSPLLFLENTEAPASPRGSSSASLVETEDPSLEDTSVPSVPLGSRQCFLYPGPGGSYGFRLSCVASGPRLFISQVTPGGSAARAGLQVGDVILEVNGYPVGGQNDLERLQQLPEAEPPLCLKLAARSLRGLEAWIPPGAAEDWALASDLL

SEQ ID NO: 57234 - protein, 571 aa, Homo sapiens; identical to SEQ ID NO: 57232

SEQ ID NO: 57235 - protein, 769 aa, Homo sapiens
MGCNMCVVQKPEEQYKVMLQVNGKELSKLSQEQTLQALRSSKEPLVIQVLRRSPRLRGDSSCHDLQLVDSGTQTDITFEHIMALGKLRPPTPPMVILEPPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 57236 - protein, 694 aa, Homo sapiens
MALGKLRPPTPPMVILEPYVLSELPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 57237 - protein, 673 aa, Homo sapiens
MTAPPISHEYYDPAEFMEGGPQEADRLDELEYEEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 57238 - protein, 660 aa, Homo sapiens
MGCNMCVVQKPEEQYKVMLQEVELYKSSHRDKLGLMVCYRTDDEEDLGIYVGEVNPNSIAAKDGRIREGDRIIQINGVDVQNREEAVAILSQEENTNISLLVARPESQLAKRWKDSDRDDFLDDFGSENEGELRARKLKSPPAQQPGNEEEKGAPDAGPGLSNSQELDSGVGRTDESTRNEESSEHDLLGDEPPSSTNTPGSLRKFGLQGDALQSRDFHFSMDSLLAEGAGLGGGDVPGLTDEEYERYRELLEIKCHLENGNQLGLLFPRASGGNSALDVNRNESLGHEMAMLEEELRHLEFKCRNILRAQKMQQLRERCMKAWLLEEESLYDLAASEPKKHELSDISELPEKSDKDSTSAYNTGESCRSTPLLVEPLPESPLRRAMAGNSNLNRTPPGPAVATPAKAAPPPGSPAKFRSLSRDPEAGRRQHAEERGRRNPKTGLTLERVGPESSPYLSRRHRGQGQEGEHYHSCVQLAPTRGLEELGHGPLSLAGGPRVGGVAAAATEAPRMEWKVKVRSDGTRYVAKRPVRDRLLKARALKIREERSGMTTDDDAVSEMKMGRYWSKEERKQHLIRAREQRKRREFMMQSRLECLREQQNGDSKPELNIIALSHRKTMKKRNKKILDNWITIQEMLAHGARSADGKRVYNPLLSVTTV

SEQ ID NO: 57239 - protein, 517 aa, Homo sapiens
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKEMGVSPCCPG

SEQ ID NO: 57240 - protein, 1033 aa, Homo sapiens
MAQGFAVGFDPLGLGDLSSGSLSSLSSRGHLGSDSGSTATRYLLRKQQRLLNGPPRGIRASSPMGRVILINSPIEANSDESDIIHSVRVEKSPAGRLGFSVRGGSEHGLGIFVSKVEEGSSAERAGLCVGDKITEVNGLSLESTTMGSAVKVLTSSSRLHMMVRRMGRVPGIKFSKEKTTWVDVVNRRLVVEKCGSTPSDTSSEDGVRRIVHLYTTSDDFCLGFNIRGGKEFGLGIYVSKVDHGGLAEENGIKVGDQVLAANGVRFDDISHSQAVEVLKGQTHIMLTIKETGRYPAYKEMVSEYCWLDRLSNGVLQQLSPASESSSSVSSCASSAPYSSGSLPSDRMDICLGQEEPGSRGPGWGRADTAMQTEPDAGGRVETWCSVRPTVILRDTAIRSDGPHPGRRLDSALSESPKTALLLALSRPRPPITRSQSYLTLWEEKQQRKKEKSGSPGEKGALQRSKTLMNLFFKGGRQGRLARDGRREAWTLDSGSLAKTYPRLDIEKAGGVGPVQKFVTWRLRRDQERGRALLSARSGSPSSQLPNVDEQVQAWESRRPLIQDLAQRLLTDDEVLAVTRHCSRYVHEGGIEDLVRPLLAILDRPEKLLLLQDIRSVVAPTDLGRFDSMVMLVELEAFEALKSRAVRPPALRPARQDTPPKRHLITPVPDSRGGFYLLPVNGFPEEEDNGELRERLGALKVSPSASAPRHPHKGIPPLQDVPVDAFTPLRIACTPPPQLPPVAPRPLRPNWLLTEPLSREHPPQSQIRGRAQSRSRSRSRSRSRSSRGQGKSPGRRSPSPVPTPAPSMTNGRYHKPRKARPPLPRPLDGEAAKVGAKQGPSESGTEGTAKEAAMKNPSGELKTVTLSKMKQSLGISISGGIESKVQPMVKIEKIFPGGAAFLSGALQAGFELVAVDGENLEQVTHQRAVDTIRRAYRNKAREPMELVVRVPGPSPRPSPSDSSALTDGGLPADHLPAHQPLDAAPVPAHWLPEPPTNPQTPPTDARLLQPTPSPAPSPALQTPDSKPAPSPRIP

SEQ ID NO: 57241 - protein, 208 aa, Homo sapiens
  MOD_RES (1)..(1): Any amino acid
XPRPPITRSQSYLTLWEEKQQRKKEKSGSPGEKGALQRSKTLMNLFFKGGRQGRLARDGRREAWTLDSGSLAKTYPRLDIEKAGGVGPVQKFVTWRLRRDQERGRALLSARSGSPSSQLPNVDEQVQAWESRRPLIQDLAQRLLTDDEVLAVTRHCSRYVHEGGIEDLVRPLLAILDRPEKLLLLQDIRSVVAPTDLGRFDSMVMLVE

SEQ ID NO: 57242 - protein, 1154 aa, Homo sapiens
MGLLLMILASAVLGSFLTLLAQFFLLYRRQPEPPADEAARAGEGFRYIKPVPGLLLREYLYGGGRDEEPSGAAPEGGATPTAAPETPAPPTRETCYFLNATILFLFRELRDTALTRRWVTKKIKVEFEELLQTKTAGRLLEGLSLRDVFLGETVPFIKTIRLVRPVVPSATGEPDGPEGEALPAACPEELAFEAEVEYNGGFHLAIDVDLVFGKSAYLFVKLSRVVGRLRLVFTRVPFTHWFFSFVEDPLIDFEVRSQFEGRPMPQLTSIIVNQLKKIIKRKHTLPNYKIRFKPFFPYQTLQGFEEDEEHIHIQQWALTEGRLKVTLLECSRLLIFGSYDREANVHCTLELSSSVWEEKQRSSIKTVELIKGNLQSVGLTLRLVQSTDGYAGHVIIETVAPNSPAAIADLQRGDRLIAIGGVKITSTLQVLKLIKQAGDRVLVYYERPVGQSNQGAVLQDNFGQLEENFLSSSCQSGYEEEAAGLTVDTESRELDSEFEDLASDVRAQNEFKDEAQSLSHSPKRVPTTLSIKPLGAISPVLNRKLAVGSHPLPPKIQSKDGNKPPPLKTSEITDPAQVSKPTQGSAFKPPVPPRPQAKVPLPSADAPNQAEPDVLVEKPEKVVPPPLVDKSAEKQAKNVDAIDDAAAPKQFLAKQEVAKDVTSETSCPTKDSSDDRQTWESSEILYRNKLGKWTRTRASCLFDIEACHRYLNIALWCRDPFKLGGLICLGHVSLKLEDVALGCLATSNTEYLSKLRLEAPSPKAIVTRTALRNLSMQKGFNDKFCYGDITIHFKYLKEGESDHHVVTNVEKEKEPHLVEEVSVLPKEEQFVGQMGLTENKHSFQDTQFQNPTWCDYCKKKVWTKAASQCMFCAYVCHKKCQEKCLAETSVCGATDRRIDRTLKNLRLEGQETLLGLPPRVDAEASKSVNKTTGLTRHIINTSSRLLNLRQVSKTRLSEPGTDLVEPSPKHTPNTSDNEGSDTEVCGPNSPSKRGNSTGIKLVRKEGGLDDSVFIAVKEIGRDLYRGLPTEERIQKLEFMLDKLQNEIDQELEHNNSLVREEKETTDTRKKSLLSAALAKSGERLQALTLLMIHYRAGIEDIETLESLSLDQHSKKISKYTDDTEEDLDNEISQLIDSQPFSSISDDLFGPSESV

SEQ ID NO: 57243 - protein, 1066 aa, Homo sapiens
MGFELDRFDGDVDPDLKCALCHKVLEDPLTTPCGHVFCAGCVLPWVVQEGSCPARCRGRLSAKELNHVLPLKRLILKLDIKCAYATRGCGRVVKLQQLPEHLERCDFAPARCRHAGCGQVLLRRDVEAHMRDACDARPVGRCQEGCGLPLTHGEQRAGGHCCARALRAHNGALQARLGALHKALKKEALRAGKREKSLVAQLAAAQLELQMTALRYQKKFTEYSARLDSLSRCVAAPPGGKGEETKSLTLVLHRDSGSLGFNIIGGRPSVDNHDGSSSEGIFVSKIVDSGPAAKEGGLQIHDRIIEVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 57244 - protein, 729 aa, Homo sapiens
MGFELDRFDGDVDPDLKCALCHKVLEDPLTTPCGHVFCAGCVLPWVVQEGSCPARCRGRLSAKELNHVLPLKRLILKLDIKCAYATRGCGRVVKLQQLPEHLERCDFAPARCRHAGCGQVLLRRDVEAHMRDACDARPVGRCQEGCGLPLTHGEQRAGGHCCARALRAHNGALQARLGALHKALKKEALRAGKREKSLVAQLAAAQLELQMTALRYQKKFTEYSARLDSLSRCVAAPPGGKGEETKSLTLVLHRDSGSLGFNIIGGRPSVDNHDGSSSEGIFVSKIVDSGPAAKEGGLQIHDRIIEVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVEGEDPQRRDALHHQEARAGPPAAGARPEDPGRAQRHDHRRRRGERDEDGALLEQGGEEAAPGEGQGAAAAARVHDAEQVGLSQGAASSR

SEQ ID NO: 57245 - protein, 783 aa, Homo sapiens
MGCSLCSLQKQEEQYKLLYEVCQVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 57246 - protein, 788 aa, Homo sapiens
MKMEHKRMILLFSKFTLIHKPHGGRWYLVNGRDLSRATHDQAVEAFKTAKEPIVVQVLRRTPRTKMFTPPSESQLVDTGTQTDITFEHIMALTKMSSPSPPVLDPYLLPEEHPSAHEYYDPNDYIGDIHQEMDREELELEEVDLYRMNSQDKLGLTVCYRTDDEDDIGIYISEIDPNSIAAKDGRIREGDRIIQINGIEVQNREEAVALLTSEENKNFSLLIARPELQLDEGWMDDDRNDFLDDLHMDMLEEQHHQAMQFTASVLQQKKHDEDGGTTDTATILSNQHEKDSGVGRTDESTRNDESSEQENNGDDATASSNPLAGQRKLTCSQDTLGSGDLPFSNESFISADCTDADYLGIPVDECERFRELLELKCQVKSATPYGLYYPSGPLDAGKSDPESVDKELELLNEELRSIELECLSIVRAHKMQQLKEQYRESWMLHNSGFRNYNTSIDVRRHELSDITELPEKSDKDSSSAYNTGESCRSTPLTLEISPDNSLRRAAEGISCPSSEGAVGTTEAYGPASKNLLSITEDPEVGTPTYSPSLKELDPNQPLESKERRASDGSRSPTPSQKLGSAYLPSYHHSPYKHAHIPAHAQHYQSYMQLIQQKSAVEYAQSQMSLVSMCKDLSSPTPSEPRMEWKVKIRSDGTRYITKRPVRDRLLRERALKIREERSGMTTDDDAVSEMKMGRYWSKEERKQHLVKAKEQRRRREFMMQSRLDCLKEQQAADDRKEMNILELSHKKMMKKRNKKIFDNWMTIQELLTHGTKSPDGTRVYNSFLSVTTV

SEQ ID NO: 57247 - protein, 776 aa, Homo sapiens
MSGKRQFFLKPLALLTCWPSTVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 57248 - protein, 1036 aa, Homo sapiens
MGFALERFAEAVDPALECKLCGQVLEEPLCTPCGHVFCASCLLPWAVRRRRCPLQCQPLAPGELYRVLPLRSLIQKLRVQCDYRARGCGHSVRLHELEAHVEHCDFGPARRLRSRGGCASGLGGGEVPARGGCGPTPRAGRGGGARGGPPGGRWGRGRGPGPRVLAWRRREKALLAQLWALQGEVQLTARRYQEKFTQYMAHVRNFVGDLGGGHRRDGEHKPFTIVLERENDTLGFNIIGGRPNQNNQEGTSTEGIYVSKILENGPADRADGLEIHDKIMEVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 57249 - protein, 778 aa, Homo sapiens
MGCNLCTFQKREEHYKLLYEVSQVNGKDLSKATHEEAVEAFRNAKEPIVVQVLRRTPLSRPAYGMASEVQLMNASTQTDITFEHIMALAKLRPPTPPVPDICPFLLSDSCHSLHPMEHEFYEDNEYISSLPADADRTEDFEYEEVELCRVSSQEKLGLTVCYRTDDEEDTGIYVSEVDPNSIAAKDGRIREGDRILQINGEDVQNREEAVALLSNDECKRIVLLVARPEIQLDEGWLEDERNEFLEELNLEMLEEEHNEAMQPTANEVEQPKKQEEEEGTTDTATSSSNNHEKDSGVGRTDESLRNDESSEQENAAEDPNSTSLKSKRDLGQSQDTLGSVELQYNESLVSGEYIDSDCIGNPDEDCERFRQLLELKCKIRNHGEYDLYYSSSTIECNQGEQEGVEHELQLLNEELRNIELECQNIMQAHRLQKVTDQYGDIWTLHDGGFRNYNTSIDMQRGKLDDIMEHPEKSDKDSSSAYNTAESCRSTPLTVDRSPDSSLPRVINLTNKKNLRSTMAATQSSSGQSSKESTSTKAKTTEQGCSAESKEKVLEGSKLPDQEKAVSEHIPYLSPYHSSSYRYANIPAHARHYQSYMQLIQQKSAVEYAQSQLSLVSMCKESQKCSEPKMEWKVKIRSDGTRYITKRPVRDRILKERALKIKEERSGMTTDDDTMSEMKMGRYWSKEERKQHLVRAKEQRRRREFMMRSRLECLKESPQSGSEGKKEINIIELSHKKMMKKRNKKILDNWMTIQELMTHGAKSPDGTRVHNAFLSVTTV

SEQ ID NO: 57250 - protein, 385 aa, Homo sapiens
MKLVRKNIEKDNAGQVTLVPEEPEDMWHTYNLVQVGDSLRASTIRKVQTESSTGSVGSNRVRTTLTLCVEAIDFDSQACQLRVKGTNIQENEYVKMGAYHTIELEPNRQFTLAKKQWDSVVLERIEQACDPAWSADVAAVVMQEGLAHICLVTPSMTLTRAKVEVNIPRKRKGNCSQHDRALERFYEQVVQAIQRHIHFDVVKCILVASPGFVREQFCDYLFQQAVKTDNKLLLENRSKFLQVHASSGHKYSLKEALCDPTVASRLSDTKAAGEVKALDDFYKMLQHEPDRAFYGLKQVEKANEAMAIDTLLISDELFRHQDVATRSRYVRLVDSVKENAGTVRIFSSLHVSGEQLSQLTGVAAILRFPVPELSDQEGDSSSEED

SEQ ID NO: 57251 - protein, 284 aa, Homo sapiens
MASYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTEAFREKDTAVQGNIRLSFEDFVTMTASRML

SEQ ID NO: 57252 - protein, 140 aa, Homo sapiens
MASYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGIHAEGAAPVWDMLSLWQREGAGELARMHNAS

SEQ ID NO: 57253 - protein, 381 aa, Homo sapiens
MHLLAILFCALWSAVLAENSDDYDLMYVNLDNEIDNGLHPTEDPTPCACGQEHSEWDKLFIMLENSQMRERMLLQATDDVLRGELQRLREELGRLAESLARPCAPGAPAEARLTSALDELLQATRDAGRRLARMEGAEAQRPEEAGRALAAVLEELRQTRADLHAVQGWAARSWLPAGCETAILFPMRSKKIFGSVHPVRPMRLESFSACIWVKATDVLNKTILFSYGTKRNPYEIQLYLSYQSIVFVVGGEENKLVAEAMVSLGRWTHLCGTWNSEEGLTSLWVNGELAATTVEMATGHIVPEGGILQIGQEKNGCCVGGGFDETLAFSGRLTGFNIWDSVLSNEEIRETGGAESCHIRGNIVGWGVTEIQPHGGAQYVS

SEQ ID NO: 57254 - protein, 473 aa, Homo sapiens
MGSGNWEVTGPPCGSRCERPPGLPRGVHGQFRSAVGLSGLRWFRRFQEVTWTHLQNIASNYNVSYNVDVRFRSLAEESQAVAQAVNRSQASVQGELAQLKAWVRKLQRRGRKVDTRLRALDLTLGERSQQRARERKAHKAQRDALQDSLARLEGLVHSQGARLAALEGRLPVAHPGTAALGPALVPTPTQPEELGPTSLKLQRDRQELRAASEHRGPPQDSSAPLQGRREPPASGSHRVLSGTAPKDPRQQAWSPQVPGEICGVGPTLVFPNASTRNVVFLSPGFVTALRALSFCSWVRTASGRLGTLLSYATEDNDNKLVLHGRDSLLPGSIHFVIGDPAFRELPLQLLLDGQWHHICVIWTSTQGRYWLHVDRRLVATGSRFREGYEIPPGGSLVLGQEQDSVGGGFDSSEAFVGSMSGLAIWDRALVPGEVANLAIGKEFPTGAILTLANAALAGGFVQGANCTCLERCP

SEQ ID NO: 57255 - protein, 478 aa, Homo sapiens
MGCSWRKTLSFFLVFVPIYLHGASSQEAAPVGPRKPFFERLRRLEEQFRRFQEVTWTHLQNIASNYNVSYNVDVRFRSLAEESQAVAQAVNRSQASVQGELAQLKAWVRKLQRRGRKVDTRLRALDLTLGERSQQRARERKAHKAQRDALQDSLARLEGLVHSQGARLAALEGRLPVAHPGTAALGPALVPTPTQPEELGPTSLKLQRDRQELRAASEHRGPPQDSSAPLQGRREPPASGSHRVLSGTAPKDPRQQAWSPQVPGEICGVGPTLVFPNASTRNVVFLSPGFVTALRALSFCSWVRTASGRLGTLLSYATEDNDNKLVLHGRDSLLPGSIHFVIGDPAFRELPLQLLLDGQWHHICVIWTSTQGRYWLHVDRRLVATGSRFREGYEIPPGGSLVLGQEQDSVGGGFDSSEAFVGSMSGLAIWDRALVPGEVANLAIGKEFPTGAILTLANAALAGGFVQGANCTCLERCP

SEQ ID NO: 57256 - protein, 388 aa, Homo sapiens
MKWLLLLGLVALSECIMYKVPLIRKKSLRRTLSERGLLKDFLKKHNLNPARKYFPQWKAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 57257 - protein, 282 aa, Homo sapiens
MKWLLLLGLVALSECIMYKVPLIRKKSLRRTLSERGLLKDFLKKHNLNPARKYFPQWKAPTLVDEQPLENYLDMEYFGTIGIGTPAQDFTVVFDTGSSNLWVPSVYCSSLACTNHNRFNPEDSSTYQSTSETVSITYGTGSMTGILGYDTVQTVAIWRSAAMGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTIN

SEQ ID NO: 57258 - protein, 249 aa, Homo sapiens
MTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQLPSEGSCISGFQGMNLPTESGELWILGDVFIRQYFTVFDRANNQVGLAPVA

SEQ ID NO: 57259 - protein, 388 aa, Homo sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTINGVQYPVPPSAYILQSEGSCISGFQGMNLPTESGELWILGDVFIRQYFTVFDRANNQVGLAPVA

SEQ ID NO: 57260 - protein, 388 aa, Homo sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQVGGISDTNQIFGLSETEPGSFLYYAPFDGILGLAYPSISSSGATPVFDNIWNQGLVSQDLFSVYLSADDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQSEGSCISGFQGMNVPTESGELWILGDVFIRQYFTVFDRANNQVGLAPVA

SEQ ID NO: 57261 - protein, 282 aa, Homo sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQTVAIWRSAAMGLVSQDLFSVYLSADDQSGSVVIFGGIDSSYYTGSLNWVPVTVEGYWQITVDSITMNGEAIACAEGCQAIVDTGTSLLTGPTSPIANIQSDIGASENSDGDMVVSCSAISSLPDIVFTIN

SEQ ID NO: 57262 - protein, 249 aa, Homo sapiens; identical to SEQ ID NO: 57258

SEQ ID NO: 57263 - protein, 388 aa, Homo sapiens; identical to SEQ ID NO: 57260

SEQ ID NO: 57264 - protein, 282 aa, Homo sapiens
MKWLLLLGLVALSECIMYKVPLIRKKSLRRTLSERGLLKDFLKKHNLNPARKYFPQWEAPTLVDEQPLENYLDMEYFGTIGIGTPAQDFTVVFDTGSSNLWVPSVYCSSLACTNHNRFNPEDSSTYQSTSETVSITYGTGSMTGILGYDTVQTVAIWRSAAMGLVSQDLFSVYLSADDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTIN

SEQ ID NO: 57265 - protein, 249 aa, Homo sapiens
MTGILGYDTVQVGGISDTNQIFGLSETEPGSFLYYAPFDGILGLAYPSISSSGATPVFDNIWNQGLVSQDLFSVYLSADDKSGSVVIFGGIDSSYYTGSLNWVPVTVEGYWQITVDSITMNGETIACAEGCQAIVDTGTSLLTGPTSPIANIQSDIGASENSDGDMVVSCSAISSLPDIVFTINGVQYPVPPSAYILQLPSEGSCISGFQGMNVPTESGELWILGDVFIRQYFTVFDRANNQVGLAPVA

SEQ ID NO: 57266 - protein, 525 aa, Homo sapiens
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 57267 - protein, 146 aa, Homo sapiens
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSR

SEQ ID NO: 57268 - protein, 394 aa, Homo sapiens
MKRNTLVELLTFWKNWHFRLLLDLTAKMKFCLRWKSMGVSVTARHQDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 57269 - protein, 271 aa, Homo sapiens
YTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIREYRRGSEGLPQASARLRGGRLALPQAVVGLWYVHHTQNLGPSPVVLSRGGQGQGRGVADLVSLPGPTMHLLPPWQVTPPSAPLGGAVTTAQSC

SEQ ID NO: 57270 - protein, 493 aa, Homo sapiens
MAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 57271 - protein, 452 aa, Homo sapiens
MAAATGPSFWLGNETLKVPLALFALNRQRLCERLRKNPAVQAGSIVVLQGGEETQRYCTDTGVLFRQESFFHWAFGVTEPGCYGVIDVDTGKSTLFVPRLPASHATWMGKIHSKEHFKEKYAVDDVQYVDEIASVLTSQKPSVLLTLRGVNTDSGSVCREASFDGISKFEVNNTILHPEIVECLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 57272 - protein, 429 aa, Homo sapiens
MAAATGPSFWLGNETLKVPLALFALNRQRLCERLRKNPAVQAGSIVVLQGGEETQRYCTDTGVLFRQIASVLTSQKPSVLLTLRGVNTDSGSVCREASFDGISKFEVNNTILHPEIVECRVFKTDMELEVLRYTNKISSEAHREVMKAVKVGMKEYELESLFEHYCYSRGGMRHSSYTCICGSGENSAVLHYGHAGAPNDRTIQNGDMCLFDMGGEYYCFASDITCSFPANGKFTADQKAVYEAVLRSSRAVMGAMKPGVWWPDMHRLADRIHLEELAHMGILSGSVDAMVQAHLGAVFMPHGLGHFLGIDVHDVGGYPEGVERIDEPGLRSLRTARHLQPGMVLTVEPGIYFIDHLLDEALADPARASFLNREVLQRFRGFGGVRIEEDVVVTDSGIELLTCVPRTVEEIEACMAGCDKAFTPFSGPK

SEQ ID NO: 57273 - protein, 117 aa, Homo sapiens
MRASSFLIVVVFLIAGTLVLEAAVTGVPVKGQDTVKGRVPFNGQDPVKGQVSVKGQDKVKAQEPVKGPVSTKPGSCPIILIRCAMLNPPNRCLKDTDCPGIKKCCEGSCGMACFVPQ

SEQ ID NO: 57274 - protein, 243 aa, Homo sapiens
MARLWGALSLWPLWAAVPWGGAAAVGVRACSSTAAPDGVEGPALRRSYWRHLRRLVLGPPEPPFSHVCQVGDPVLRGVAAPVERAQLGGPELQRLTQRLVQVMRRRRCVGLSAPQLGVPRQVLALELPEALCRECPPRQRALRQMEPFPLRVFVNPSLRVLDSRLVTFPEGCESVAGFLACVPRFQAVQISGLDPNGEQVVWQASGWAARIIQHEMDHLQGCLFIDKMDSRTFTNVYWMKVND

SEQ ID NO: 57275 - protein, 97 aa, Homo sapiens
MVFVRRPWPALTTVLLALLVCLGALVDAYPIKPEAPREDASPEELNRYYASLRHYLNLVTRQRYGKRDGPDTLLSKTFFPDGEDRPVRSRSEGPDLW

SEQ ID NO: 57276 - protein, 663 aa, Homo sapiens
MAPKRVVQLSLKMPTHAVCVVGVEAHVDIHSDVPKGANSFRVSGSSGVEVFMVYNRTRVKEPIGKARWPLDTDADMVVSVGTASKELKDFKVRVSYFGEQEDQALGRSVLYLTGVDISLEVDTGRTGKVKRSQGDKKTWRWGPEGYGAILLVNCDRDNHRSAEPDLTHSWLMSLADLQDMSPMLLSCNGPDKLFDSHKLVLNVPFSDSKRVRVFCARGGNSLSDYKQVLGPQCLSYEVERQPGEQEIKFYVEGLTFPDADFLGLVSLSVSLVDPGTLPEVTLFTDTVGFRMAPWIMTPNTQPPEELYVCRVMDTHGSNEKFLEDMSYLTLKANCKLTICPQVENRNDRWIQDEMEFGYIEAPHKSFPVVFDSPRNRGLKDFPYKRILGPDFGYVTREIPLPGPSSLDSFGNLDVSPPVTVGGTEYPLGRILIGSSFPKSGGRQMARAVRNFLKAQQVQAPVELYSDWLSVGHVDEFLTFVPTSDQKGFRLLLASPSACLKLFQEKKEEGYGEAAQFDGLKHQAKRSINEMLADRHLQRDNLHAQKCIDWNRNVLKRELGLAESDIVDIPQLFFLKNFYAEAFFPDMVNMVVLGKYLGIPKPYGPIINGRCCLEEKVQSLLEPLGLHCIFIDDYLSYHELQGEIHCGTNVRRKPFPFKWWNMVP

SEQ ID NO: 57277 - protein, 178 aa, Homo sapiens
MARAVRNFLKAQQVQAPVELYSDWLSVGHVDEFLTFVPTSDQKGFRLLLASPSACLKLFQEKKEEGYGEAAQFDGLKHQAKRSINEMLADRHLQRDNLHAQVNMVVLGKYLGIPKPYGPIINGRCCLEEKVQSLLEPLGLHCIFIDDYLSYHELQGEIHCGTNVRRKPFPFKWWNMVP

SEQ ID NO: 57278 - protein, 134 aa, Homo sapiens
MLADRHLQRDNLHAQKCIDWNRNVLKRELGLAESDIVDIPQLFFLKNFYAEAFFPDMVNMVVLGKYLGIPKPYGPIINGRCCLEEKVQSLLEPLGLHCIFIDDYLSYHELQGEIHCGTNVRRKPFPFKWWNMVP

SEQ ID NO: 57279 - protein, 220 aa, Homo sapiens
MARAVRNFLKAQQVQAPVELYSDWLSVGHVDEFLTFVPTSDQKGFRLLLASPSACLKLFQEKKEEGYGEAAQFDGLKHQAKRSINEMLADRHLQRDNLHAQKCIDWNRNVLKRELGLAESDIVDIPQLFFLKNFYAEAFFPDMVNMVVLGKYLGIPKPYGPIINGRCCLEEKVQSLLEPLGLHCIFIDDYLSYHELQGEIHCGTNVRRKPFPFKWWNMVP

SEQ ID NO: 57280 - protein, 437 aa, Homo sapiens
MLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKASWTWGPEGQGAILLVNCDRETPWLPKEDCRDEKVYSKEDLKDMSQMILRTKGPDRLPAGYEIVLYISMSDSDKVGVFYVENPFFGQRYIHILGRRKLYHVVKYTGGSAELLFFVEGLCFPDEGFSGLVSIHVSLLEYMAQDIPLTPIFTDTVIFRIAPWIMTPNILPPVSVFVCCMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPL

SEQ ID NO: 57281 - protein, 665 aa, Homo sapiens
MLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKASWTWGPEGQGAILLVNCDRETPWLPKEDCRDEKVYSKEDLKDMSQMILRTKGPDRLPAGYEIVLYISMSDSDKVGVFYVENPFFGQRYIHILGRRKLYHVVKYTGGSAELLFFVEGLCFPDEGFSGLVSIHVSLLEYMAQDIPLTPIFTDTVIFRIAPWIMTPNILPPVSVFVCCMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPLSGGRRMTKVVRDFLKAQQVQAPVELYSDWLTVGHVDEFMSFVPIPGTKKFLLLMASTSACYKLFREKQKDGHGEAIMFKGLGGMSSKRITINKILSNESLVQENLYFQRCLDWNRDILKKELGLTEQDIIDLPALFKMDEDHRARAFFPNMVNMIVLDKDLGIPKPFGPQVEEECCLEMHVRGLLEPLGLECTFIDDISAYHKFLGEVHCGTNVRRKPFTFKWWHMVP

SEQ ID NO: 57282 - protein, 549 aa, Homo sapiens
MLRERTVRLQYGSRVEAVYVLGTYLWTDVYSAAPAGAQTFSLKHSEHVWVEVVRDGEAEEVATNGKQRWLLSPSTTLRVTMSQASTEASSDKVTVNYYDEEGSIPIDQAGLFLTAIEISLDVDADRDGVVEKNNPKKTRSSANAISTSWAGGSSTMWSSTRVAPRSCCSSWKASVSPTRASQAWSPSMSACWSTWPSMKDNYLFLKEVKNLVEKTNCELKVCFQYLNRGDRWIQDEIEFGYIEAPHKGFPVVLDSPRDGNLKDFPVKELLGPDFGYVTREPLFESVTSLDSFGNLEVSPPVTVNGKTYPLGRILIGSSFPLSGGRRMTKVVRDFLKAQQVQAPVELYSDWLTVGHVDEFMSFVPIPGTKKFLLLMASTSACYKLFREKQKDGHGEAIMFKGLGGMSSKRITINKILSNESLVQENLYFQRCLDWNRDILKKELGLTEQDIIDLPALFKMDEDHRARAFFPNMVNMIVLDKDLGIPKPFGPQVEEECCLEMHVRGLLEPLGLECTFIDDISAYHKFLGEVHCGTNVRRKPFTFKWWHMVP

SEQ ID NO: 57283 - protein, 664 aa, Homo sapiens
MSLQRIVRVSLEHPTSAVCVAGVETLVDIYGSVPEGTEMFEVYGTPGVDIYISPNMERGRERADTRRWRFDATLEIIVVMNSPSNDLNDSHVQISYHSSHEPLPLAYAVLYLTCVDISLDCDLNCEGRQDRNFVDKRQWVWGPSGYGGILLVNCDRDDPSCDVQDNCDQHVHCLQDLEDMSVMVLRTQGPAALFDDHKLVLHTSSYDAKRAQVFHICGPEDVCEAYRHVLGQDKVSYEVPRLHGDEERFFVEGLSFPDAGFTGLISFHVTLLDDSNEDFSASPIFTDTVVFRVAPWIMTPSTLPPLEVYVCRVRNNTCFVDAVAELARKAGCKLTICPQAENRNDRWIQDEMELGYVQAPHKTLPVVFDSPRNGELQDFPYKRILGPDFGYVTREPRDRSVSGLDSFGNLEVSPPVVANGKEYPLGRILIGGNLPGSSGRRVTQVVRDFLHAQKVQPPVELFVDWLAVGHVDEFLSFVPAPDGKGFRMLLASPGACFKLFQEKQKCGHGRALLFQGVVDDEQVKTISINQVLSNKDLINYNKFVQSCIDWNREVLKRELGLAECDIIDIPQLFKTERKKATAFFPDLVNMLVLGKHLGIPKPFGPIINGCCCLEEKVRSLLEPLGLHCTFIDDFTPYHMLHGEVHCGTNVCRKPFSFKWWNMVP

SEQ ID NO: 57284 - protein, 214 aa, Homo sapiens
MAQGTLIRVTPEQPTHAVCVLGTLTQLDICSSAPEDCTSFSINASPGVVVDIAHGPPAKKKSTGSSTWPLDPGVEVTLTMKVASGSTGDQKVQISYYGPKTPPVKALLYLTGVDGVSPCHPGWSAMHDLAHCNLRLQVQAILCFSVPSSWTTGACHHAWLIFVFLVEMEFHHVGQAGLELLTSGDLPASGSQSARITGMNHCARPSIFLILKYL

SEQ ID NO: 57285 - protein, 663 aa, Homo sapiens
MAQGTLIRVTPEQPTHAVCVLGTLTQLDICSSAPEDCTSFSINASPGVVVDIAHGPPAKKKSTGSSTWPLDPGVEVTLTMKVASGSTGDQKVQISYYGPKTPPVKALLYLTGVEISLCADITRTGKVKPTRAVKDQRTWTWGPCGQGAILLVNCDRDNLESSAMDCEDDEVLDSEDLQDMSLMTLSTKTPKDFFTNHTLVLHVARSEMDKVRVFQATRGKLSSKCSVVLGPKWPSHYLMVPGGKHNMDFYVEALAFPDTDFPGLITLTISLLDTSNLELPEAVVFQDSVVFRVAPWIMTPNTQPPQEVYACSIFENEDFLKSVTTLAMKAKCKLTICPEEENMDDQWMQDEMEIGYIQAPHKTLPVVFDSPRNRGLKEFPIKRVMGPDFGYVTRGPQTGGISGLDSFGNLEVSPPVTVRGKEYPLGRILFGDSCYPSNDSRQMHQALQDFLSAQQVQAPVKLYSDWLSVGHVDEFLSFVPAPDRKGFRLLLASPRSCYKLFQEQQNEGHGEALLFEGIKKKKQQKIKNILSNKTLREHNSFVERCIDWNRELLKRELGLAESDIIDIPQLFKLKEFSKAEAFFPNMVNMLVLGKHLGIPKPFGPVINGRCCLEEKVCSLLEPLGLQCTFINDFFTYHIRHGEVHCGTNVRRKPFSFKWWNMVP

SEQ ID NO: 57286 - protein, 127 aa, Homo sapiens
MAQGTLIRVTPEQPTHAVCVLGTLTQLDICSSAPEDCTSFSINASPGVVVDIAHGPPAKKKSTGSSTWPLDPGVEVTLTMKVASGSTGDQKVQISYYGPKTPPVKALLYLTGVDGVSPCHPGWSAMA

SEQ ID NO: 57287 - protein, 875 aa, Homo sapiens
MDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKAEAVVETKMENKPTSSELQKMQEKQKLIKEPGSGVPVVLITTLLVIPVVVLLAIAIFIRWKKSRAFGDSEHKLETSSGRVLGRFRGKGSGGLNLGNFFASRKGYSRKGFDRLSTEGSDQEKEDDGSESEEEYSAPLPALAPSSS

SEQ ID NO: 57288 - protein, 974 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGADSEHKLETSSGRVLGRFRGKGSGGLNLGNFFASRKGYSRKGFDRLSTEGSDQEKEDDGSESEEEYSAPLPALAPSSS

SEQ ID NO: 57289 - protein, 887 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKGKGSGGLNLGNFFASRKGYSRKGFDRLSTEGSDQEKEDDGSESEEEYSAPLPALAPSSS

SEQ ID NO: 57290 - protein, 866 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGDSEHKLETSSGRVLGRFRGKGSGGLNLGNFFASRKGYSRKGFDRLSTEGSDQEKEDDGSESEEEYSAPLPALAPSSS

SEQ ID NO: 57291 - protein, 335 aa, Homo sapiens
MQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKEAEAVVETKMENKPTSSELQKMQEKQKLIKEPGSGVPVVLITTLLVIPVVVLLAIAIFIRWKKSRAFGGKGSGGLNLGNFFASRKGYSRKGFDRLSTEGSDQEKEDDGSESEEEYSAPLPALAPSSS

SEQ ID NO: 57292 - protein, 155 aa, Homo sapiens
MHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGARREDMKCFQCKEMISVQ

SEQ ID NO: 57293 - protein, 973 aa, Homo sapiens [sequence omitted]

SEQ ID NO: 57294 - protein, 905 aa, Homo sapiens
MAGRVPSLLVLLVFPSSCLAFRSPLSVFKRFKETTRPFSNECLGTTRPVVPIDSSDFALDIRMPGVTPKQSDTYFCMSMRIPVDEEAFVIDFKPRASMDTVHHMLLFGCNMPSSTGSYWFCDEGTCTDKANILYAWARNAPPTRLPKGVGFRVGGETGSKYFVLQVHYGDISAFRDNNKDCSGVSLHLTRLPQPLIAGMYLMMSVDTVIPAGEKVVNSDISCHYKNYPMHVFAYRVHTHHLGKVVSGYRVRNGQWTLIGRQSPQLPQAFYPVGHPVDVSFGDLLAARCVFTGEGRTEATHIGGTSSDEMCNLYIMYYMEAKHAVSFMTCTQNVAPDMFRTIPPEANIPIPVKSDMVMMHEHHKETEYKDKIPLLQQPKREEEEVLDQGDFYSLLSKLLGEREDVVHVHKYNPTEKAESESDLVAEIANVVQKKDLGRSDAREGAEHERGNAILVRDRIHKFHRLVSTLRPPESRVFSLQQPPPGEGTWEPEHTGDFHMEEALDWPGVYLLPGQVSGVALDPKNNLVIFHRGDHVWDGNSFDSKFVYQQIGLGPIEEDTILVIDPNNAAVLQSSGKNLFYLPHGLSIDKDGNYWVTDVALHQVFKLDPNNKEGPVLILGRSMQPGSDQNHFCQPTDVAVDPGTGAIYVSDGYCNSRIVQFSPSGKFITQWGEESSGSSPLPGQFTVPHSLALVPLLGQLCVADRENGRIQCFKTDTKEFVREIKHSSFGRNVFAISYIPGLLFAVNGKPHFGDQEPVQGFVMNFSNGEIIDIFKPVRKHFDMPHDIVASEDGTVYIGDAHTNTVWKFTLTEKLEHRSVKKAGIEVQEIKDSEHKLETSSGRVLGRFRGKGSGGLNLGNFFASRKGYSRKGFDRLSTEGSDQEKEDDGSESEEEYSAPLPALAPSSS

SEQ ID NO: 57295 - protein, 29 aa, Homo sapiens
MAGRVPSLLVLLVFPSSCLAFRSPLSVFK

SEQ ID NO: 57296 - protein, 28 aa, Homo sapiens
MAGRVPSLLVLLVFPSSCLAFRSPLSVF

SEQ ID NO: 57297 - protein, 53 aa, Homo sapiens
MAGRVPSLLVLLVFPSSCLAFRSPLSVFKRFKETTRPFSNECLGTTRPVVPID

SEQ ID NO: 57298 - protein, 42 aa, Homo sapiens
MAGRVPSLLVLLVFPSSCLAFRSPLSVFKRFKETTRPFSNEC

SEQ ID NO: 57299 - protein, 68 aa, Homo sapiens
MAGRVPSLLVLLVFPSSCLAFRSPLSVFKRFKETTRPFSNECLGTTRPVVPIDSSDFALDIRMPGVTP

SEQ ID NO: 57300 - protein, 25 aa, Homo sapiens
MAGRVPSLLVLLVFPSSCLAFRSPL

SEQ ID NO: 57301 - protein, 166 aa, Homo sapiens
MAAIPPDSWQPPNVYLETSMGIIVLELYWKHAPKTCKNFAELARRGYYNGTKFHRIIKDFMIQGGDPTGTGRGGASIYGKQFEDELHPDLKFTGAGILAMANAGPDTNGSQFFVTLAPTQWLDGKHTIFGRVCQGIGMVNRVGMVETNSQDRPVDDVKIIKAYPSG

SEQ ID NO: 57302 - protein, 520 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATKRAAEEEPSTSATVPMSKKKPSRGFGDFSSW

SEQ ID NO: 57303 - protein, 520 aa, Homo sapiens; identical to SEQ ID NO: 57302

SEQ ID NO: 57304 - protein, 520 aa, Homo sapiens; identical to SEQ ID NO: 57302

SEQ ID NO: 57305 - protein, 527 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKVAPETKVKSSQPQAGSQGPQTFRQGVGKYINPAATEQQRKSPQPVPLSPCPRRSPVGVLGTSAPGSSRLPDDH

SEQ ID NO: 57306 - protein, 489 aa, Homo sapiens
MGKRQHQKDKMYITCAEYTHFYGGKKPDLPQTNFRRLPFDHCRNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAMVPETTHEAAAIDEDVLRYQFVKKKGYVRLHTNKGDLNLELHCDLTPKTCENFIRLCKKHYYDGTIFHRSIRNFVIQGGDPTGTGTGGESYWGKPFKDEFRPNLSHTGRGILSMANSGPNSNRSQFFITFRSCAYLDKKHTIFGRVVGGFDVLTAMENVESDPKTDRPKEEIRIDATTVFVDPYEEADAQIAQERKTQLKEASSRGRALNQCHCPHVQEEAQSGFWGLQLLVAAATCRLYLCPSFSHQSLMLKLQA

SEQ ID NO: 57307 - protein, 520 aa, Homo sapiens; identical to SEQ ID NO: 57302

SEQ ID NO: 57308 - protein, 492 aa, Homo sapiens
MAVLLETTLGDVVIDLYTEERPRACLNFLKLCKIKYYNYCLIHNVQRDFIIQTGDPTGTGRGGESIFGQLYGDQASFFEAEKVPRIKHKKKGTVSMVNNGSDQHGSQFLITTGENLDYLDGVHTVFGEVTEGMDIIKKINETFVDKDFVPYQDIRINHTVILDDPFDDPPDLLIPDRSPEPTREQLDSGRIGADEEIDDFKGRSAEEVEEIKAEKEAKTQAILLEMVGDLPDADIKPPENVLFVCKLNPVTTDEDLEIIFSRFGPIRSCEVIRDWKTGESLCYAFIEFEKEEDCEKAFFKMDNVLIDDRRIHVDFSQSVAKVKWKGKGGKYTKSDFKEYEKEQDKPPNLVLKDKVKPKQDTKYDLILDEQAEDSKSSHSHTSKKHKKKTHHCSEEKEDEDYMPIKNTNQDIYREMGFGHYEEEESCWEKQKSEKRDRTQNRSRSRSRERDGHYSNSHKSKYQTDLYERERSKKRDRSRSPKKSKDKEKSKYR

SEQ ID NO: 57309 - protein, 127 aa, Homo sapiens
MSRPKTQNQVTHTQVKNTRRKPITVLKRKKMRTTCQSKILIRISIEKWGLVTMKKKKAVGRNKRVKRETELRTEVVADLERGMAIIVIVINQNTKQIFMKEKGVKRETEAEVQRSPKIKKNLSIDER

SEQ ID NO: 57310 - protein, 105 aa, Homo sapiens
MCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 57311 - protein, 129 aa, Homo sapiens
MVNPTVFFDIAVDGEPLGRVSFELFADKVPKTAENFRALSTGEKGFGYKGSCFHRIIPGFMCQGGDFTRHNGTGGKSICTAKTEWLDGKHVVFGKVKEGMNIVEAMERFGSRNGKTSKKITIADCGQLE

SEQ ID NO: 57312 - protein, 165 aa, Homo sapiens
MVNPTVFFDIAVDGEPLGRVSFELFADKVPKTAENFRALSTGEKGFGYKGSCFHRIIPGFMCQGGDFTRHNGTGGKSIYGEKFEDENFILKHTGPGILSMANAGPNTNGSQFFICTAKTEWLDGKHVVFGKVKEGMNIVEAMERFGSRNGKTSKKITIADCGQLE

SEQ ID NO: 57313 - protein, 164 aa, Homo sapiens
MVNSVVFFDITVDGKPLGRISIKLFADKILKTAENFRALSTGEKGFRYKGSCFHRIIPGFMCQGGDFTRHNGTGDKSIYGEKFDDENLIRKHTGSGILSMANAGPNTNGSQFFICAAKTEWLDGKHVAFGKVKERVNIVEAMEHFGYRNSKTSKKITIADCGQF

SEQ ID NO: 57314 - protein, 216 aa, Homo sapiens
MLRLSERNMKVLLAAALIAGSVFFLLLPGPSAADEKKKGPKVTVKVYFDLRIGDEDVGRVIFGLFGKTVPKTVDNFVALATGEKGFGYKNSKFHRVIKDFMIQGGDFTRGDGTGGKSIYGERFPDENFKLKHYGPGWVSMANAGKDTNGSQFFITTVKTAWLDGKHVVFGKVLEGMEVVRKVESTKTDSRDKPLKDVIIADCGKIEVEKPFAIAKE

SEQ ID NO: 57315 - protein, 212 aa, Homo sapiens
MGPGPRLLLPLVLCVGLGALVFSSGAEGFRKRGPSVTAKVFFDVRIGDKDVGRIVIGLFGKVVPKTVENFVALATGEKGYGYKGSKFHRVIKDFMIQGGDITTGDGTGGVSIYGETFPDENFKLKHYGIGWVSMANAGPDTNGSQFFITLTKPTWLDGKHVVFGKVIDGMTVVHSIELQATDGHDRPLTNCSIINSGKIDVKTPFVVEIADW

SEQ ID NO: 57316 - protein, 370 aa, Homo sapiens
MSHPSPQAKPSNPSNPRVFFDVDIGGERVGRIVLELFADIVPKTAENFRALCTGEKGIGHTTGKPLHFKGCPFHRIIKKFMIQGGDFSNQNGTGGESIYGEKFEDENFHYKHDREGLLSMANAGRNTNGSQFFITTVPTPHLDGKHVVFGQVIKGIGVARILENVEVKGEKPAKLCVIAECGELKEGDDGGIFPKDGSGDSHPDFPEDADIDLKDVDKILLITEDLKNIGNTFFKSQNWEMAIKKYAEVLRYVDSSKAVIETADRAKLQPIALSCVLNIGACKLKMSNWQGAIDSCLEALELDPSNTKALYRRAQGWQGLKEYDQALADLKKAQGIAPEDKAIQAELLKVKQKIKAQKDKEKAVYAKMFA

SEQ ID NO: 57317 - protein, 207 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 57318 - protein, 155 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGWMASMLCSVTSKRAWTS

SEQ ID NO: 57319 - protein, 165 aa, Homo sapiens
  MOD_RES (1)..(1): Any amino acid
XSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWSMALDDIALHCCSPGSPVLTGWMASMLCSVTSKRAWTS

SEQ ID NO: 57320 - protein, 754 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRNSEKDDKYKNKVKKRAKSKSRSKSKEKSKSKERDSKHNRNEEKRMRSRSKGRDHENVKEKEKQSDSKGKDQERSRSKEKSKQLESKSNEHDHSKSKEKDRRAQSRSRECDITKGKHSYNSRTRERSRSRDRSRRVRSRTHDRDRSRSKEYHRYREQEYRRRGRSRSRERRTPPGRSRSKDRRRRRRDSRSSEREESQSRNKDKYRNQESKSSHRKENSESEKRMYSKSRDHNSSNNSREKKADRDQSPFSKIKQSSQDNELKSSMLKNKEDEKIRSSVEKENQKSKGQENDHVHEKNKKFDHESSPGTDEDKSG

SEQ ID NO: 57321 - protein, 246 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKK

SEQ ID NO: 57322 - protein, 59 aa, Homo sapiens
MGIKVQRPRCFFDIAINNQPAGRVVFELFSDVCPKTCENFRCLCTGEKGTGKSTQKPLH

SEQ ID NO: 57323 - protein, 754 aa, Homo sapiens; identical to SEQ ID NO: 57320

SEQ ID NO: 57324 - protein, 448 aa, Homo sapiens
MGIKVQRPRCFFDIAINNQPAGRVVFELFSDVCPKTCENFRCLCTGEKGTGKSTQKPLHYKSCLFHRVVKDFMVQGGDFSEGNGRGGESIYGGFFEDESFAVKHNKEFLLSMANRGKDTNGSQFFITTKPTPHLDGHHVVFGQVISGQEVVREIENQKTDAASKPFAEVRILSCGELIPKSKVKKEEKKRHKSSSSSSSSSSDSDSSSDSQSSSDSSDSESATEEKSKKRKKKHRKNSRKHKKEKKKRKKSKKSASSESEAENLEAQPQSTVRPEEIPPIPENRFLMRKSPPKADEKERKNRERERERECNPPNSQPASYQRRLLVTRSGRKIKGRGPRRYRTPSRSRSRDRFRRSETPPHWRQEMQRAQRMRVSSGERWIKGDKSELNEIKENQRSPVRVKERKITDHRNVSESPNRKNEKEKKVKDHKSNSKERDIRRKKKKKKKK

SEQ ID NO: 57325 - protein, 177 aa, Homo sapiens
MAVANSSPVNPVVFFDVSIGGQEVGRMKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 57326 - protein, 57 aa, Homo sapiens
MKIELFADVVPKTAENFRQFCTGEFRSVSDVFDFFACSRGVFWGCSEGIGEPPAGLE

SEQ ID NO: 57327 - protein, 134 aa, Homo sapiens
MIAGDSDRRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVVISQCGEM

SEQ ID NO: 57328 - protein, 68 aa, Homo sapiens
MVNWKGLVLPAVTPSLFLFGYRKDGVPIGYKGSTFHRVIKDFMIQGGDFVNVSTIPFLSKTRSFSFCC

SEQ ID NO: 57329 - protein, 144 aa, Homo sapiens
MKIELFADVVPKTAENFRQFCTGEFRKDGVPIGYKGSTFHRVIKDFMIQGGDFVNGDGTGVASIYRGPFADENFKLRHSAPGLLSMANSGPSTNGCQFFITCSKCDWLDGKHVVFGKIIDGLLVMRKIENVPTGPNNKPKLPVV

SEQ ID NO: 57330 - protein, 134 aa, Homo sapiens; identical to SEQ ID NO: 57327

SEQ ID NO: 57331 - protein, 179 aa, Homo sapiens
MPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGHLKLY

SEQ ID NO: 57332 - protein, 180 aa, Homo sapiens
MMPSKSLVMEYLAHPSTLGLAVGVACGMCLGWSLRVCFGMLPKSKTSKTHTDTESEASILGDSGEYKMILVVRNDLKMGKGKVAAQCSHAAVSAYKQIQRRNPEMLKQWEYCGQPKVVVKAPDEETLIALLAHAKMLGLTVSLIQDAGRTQIAPGSQTVLGIGPGPADLIDKVTGHLKLY

SEQ ID NO: 57333 - protein, 179 aa, Homo sapiens; identical to SEQ ID NO: 57331

SEQ ID NO: 57334 - protein, 555 aa, Homo sapiens
MAARLLLLGILLLLLPLPVPAPCHTAARSECKRSHKFVPGAWLAGEGVDVTSLRRSGSFPVDTQRFLRPDGTCTLCENALQEGTLQRLPLALTNWRAQGSGCQRHVTRAKVSSTEAVARDAARSIRNDWKVGLDVTPKPTSNVHVSVAGSHSQAANFAAQKTHQDQYSFSTDTVECRFYSFHVVHTPPLHPDFKRALGDLPHHFNASTQPAYLRLISNYGTHFIRAVELGGRISALTALRTCELALEGLTDNEVEDCLTVEAQVNIGIHGSISAEAKACEEKKKKHKMTASFHQTYRERHSEVVGGHHTSINDLLFGIQAGPEQYSAWVNSLPGSPGLVDYTLEPLHVLLDSQDPRREALRRALSQYLTDRARWRDCSRPCPPGRQKSPRDPCQCVCHGSAVTTQDCCPRQRGLAQLEVTFIQAWGLWGDWFTATDAYVKLFFGGQELRTSTVWDNNNPIWSVRLDFGDVLLATGGPLRLQVWDQDSGRDDDLLGTCDQAPKSGSHEVRCNLNHGHLKFRYHARCLPHLGGGTCLDYVPQMLLGEPPGNRSGAVW

SEQ ID NO: 57335 - protein, 555 aa, Homo sapiens; identical to SEQ ID NO: 57334

SEQ ID NO: 57336 - protein, 555 aa, Homo sapiens; identical to SEQ ID NO: 57334

SEQ ID NO: 57337 - protein, 147 aa, Homo sapiens
MEARSRSAEELRRAELVEIIVETEAQTGVSGINVAGGGKEGIFVRELREDSPAARSLSLQEGDQLLSARVFFENFKYEDALRLLQCAEPYKVSFCLKRTVPTGDLALRPGTVSGYEIKGPRAKVAKLVRVLSPAPALDCPSDPVSAP

SEQ ID NO: 57338 - protein, 1461 aa, Homo sapiens
MEARSRSAEELRRAELVEIIVETEAQTGVSGINVAGGGKEGIFVRELREDSPAARSLSLQEGDQLLSARVFFENFKYEDALRLLQCAEPYKVSFCLKRTVPTGDLALRPGTVSGYEIKGPRAKVAKLNIQSLSPVKKKKMVPGALGVPADLAPVDVEFSFPKFSRLRRGLKAEAVKGPVPAAPARRRLQLPRLRVREVAEEAQAARLAAAAPPPRKAKVEAEVAAGARFTAPQVELVGPRLPGAEVGVPQVSAPKAAPSAEAAGGFALHLPTLGLGAPAPPAVEAPAVGIQVPQVELPALPSLPTLPTLPCLETREGAVSVVVPTLDVAAPTVGVDLALPGAEVEARGEAPEVALKMPRLSFPRFGARAKEVAEAKVAKVSPEARVKGPRLRMPTFGLSLLEPRPAAPEVVESKLKLPTIKMPSLGIGVSGPEVKVPKGPEVKLPKAPEVKLPKVPEAALPEVRLPEVELPKVSEMKLPKVPEMAVPEVRLPEVELPKVSEMKLPKVPEMAVPEVRLPEVQLLKVSEMKLPKVPEMAVPEVRLPEVQLPKVSEMKLPEVSEVAVPEVRLPEVQLPKVPEMKVPEMKLPKVPEMKLPEMKLPEVQLPKVPEMAVPDVHLPEVQLPKVPEMKLPEMKLPEVKLPKVPEMAVPDVHLPEVQLPKVPEMKLPKMPEMAVPEVRLPEVQLPKVSEMKLPKVPEMAVPDVHLPEVQLPKVCEMKVPDMKLPEIKLPKVPEMAVPDVHLPEVQLPKVSEIRLPEMQVPKVPDVHLPKAPEVKLPRAPEVQLKATKAEQAEGMEFGFKMPKMTMPKLGRAESPSRGKPGEAGAEVSGKLVTLPCLQPEVDGEAHVGVPSLTLPSVELDLPGALGLQGQVPAAKMGKGERVEGPEVAAGVREVGFRVPSVEIVTPQLPAVEIEEGRLEMIETKVKPSSKFSLPKFGLSGPKVAKAEAEGAGRATKLKVSKFAISLPKARVGAEAEAKGAGEAGLLPALDLSIPQLSLDAHLPSGKVEVAGADLKFKGPRFALPKFGVRGRDTEAAELVPGVAELEGKGWGWDGRVKMPKLKMPSFGLARGKEAEVQGDRASPGEKAESTAVQLKIPEVELVTLGAQEEGRAEGAVAVSGMQLSGLKVSTAGQVVTEGHDAGLRMPPLGISLPQVELTGFGEAGTPGQQAQSTVPSAEGTAGYRVQVPQVTLSLPGAQVAGGELLVGEGVFKMPTVTVPQLELDVGLSREAQAGEAATGEGGLRLKLPTLGARARVGGEGAEEQPPGAERTFCLSLPDVELSPSGGNHAEYQVAEGEGEAGHKLKVRLPRFGLVRAKEGAEEGEKAKSPKLRLPRVGFSQSEMVTGEGSPSPEEEEEEEEEGSGEGASGRRGRVRVRLPRVGLAAPSKASRGQEGDAAPKSPVREKSPKFRFPRVSLSPKARSGSGDQEEGGLRVRLPSVGFSETGAPGPARMEGAQAAAV

SEQ ID NO: 57339 - protein, 1396 aa, Homo sapiens
MEARSRSAEELRRAELVEIIVETEAQTGVSGINVAGGGKEGIFVRELREDSPAARSLSLQEGDQLLSARVFFENFKYEDALRLLQCAEPYKVSFCLKRTVPTGDLALRPGTVSGYEIKGPRAKVAKLNIQSLSPVKKKKMVPGALGVPADLAPVDVEFSFPKFSRLRRGLKAEAVKGPVPAAPARRRLQLPRLRVREVAEEAQAARLAAAAPPPRKAKVEAEVAAGARFTAPQVELVGPRLPGAEVGVPQVSAPKAAPSAEAAGGFALHLPTLGLGAPAPPAVEAPAVGIQVPQVELPALPSLPTLPTLPCLETREGAVSVVVPTLDVAAPTVGVDLALPGAEVEARGEAPEVALKMPRLSFPRFGARAKEVAEAKVAKVSPEARVKGPRLRMPTFGLSLLEPRPAAPEVVESKLKLPTIKMPSLGIGVSGPEVKVPKGPEVKLPKAPEVKLPKVPEAALPEVRLPEVELPKVSEMKLPKVPEMAVPEVRLPEVELPKVSEMKLPKVPEMAVPEVRLPEVQLLKVSEMKLPKVPEMAVPEVRLPEVQLPKVSEMKLPEVSEVAVPEVRLPEVQLPKVPEMKVPEMKLPKVPEMKLPEMKLPEVQLPKVPEMAVPDVHLPEVQLPKVPEMKLPEMKLPEVKLPKVPEMAVPDVHLPEVQLPKVPEMKLPKMPEMAVPEVRLPEVQLPKVSEMKLPKVPEMAVPDVHLPEVQLPKVCEMKVPDMKLPEIKLPKVPEMAVPDVHLPEVQLPKVSEIRLPEMQVPKVPDVHLPKAPEVKLPRAPEVQLKATKAEQAEGMEFGFKMPKMTMPKLGRAESPSRGKPGEAGAEVSGKLVTLPCLQPEVDGEAHVGVPSLTLPSVELDLPGALGLQGQVPAAKMGKGERVEGPEVAAGVREVGFRVPSVEIVTPQLPAVEIEEGRLEMIETKVKPSSKFSLPKFGLSGPKVAKAEAEGAGRATKLKVSKFAISLPKARVGAEAEAKGAGEAGLLPALDLSIPQLSLDAHLPSGKVEVAGADLKFKGPRFALPKFGVRGRDTEAAELVPGVAELEGKGWGWDGRVKMPKLKVSTAGQVVTEGHDAGLRMPPLGISLPQVELTGFGEAGTPGQQAQSTVPSAEGTAGYRVQVPQVTLSLPGAQVAGGELLVGEGVFKMPTVTVPQLELDVGLSREAQAGEAATGEGGLRLKLPTLGARARVGGEGAEEQPPGAERTFCLSLPDVELSPSGGNHAEYQVAEGEGEAGHKLKVRLPRFGLVRAKEGAEEGEKAKSPKLRLPRVGFSQSEMVTGEGSPSPEEEEEEEEEGSGEGASGRRGRVRVRLPRVGLAAPSKASRGQEGDAAPKSPVREKSPKFRFPRVSLSPKARSGSGDQEEGGLRVRLPSVGFSETGAPGPARMEGAQAAAV

SEQ ID NO: 57340 - protein, 737 aa, Homo sapiens
MEVEQEQRRRKVEAGRTKLAHFRQRKTKGDSSHSEKKTAKRKGSAVDASVQEESPVTKEDSALCGGGDICKSTSCDDTPDGAGGAFAAQPEDCDGEKREDLEQLQQKQVNDHPPEQCGMFTVSDHPPEQHGMFTVGDHPPEQRGMFTVSDHPPEQRGMFTISDHQPEQRGMFTVSDHTPEQRGIFTISDHPAEQRGMFTKECEQECELAITDLESGREDEAGLHQSQAVHGLELEALRLSLSNMHTAQLELTQANLQKEKETALTELREMLNSRRAQELALLQSRQQHELELLREQHAREKEEVVLRCGQEAAELKEKLQSEMEKNAQIVKTLKEDWESEKDLCLENLRKELSAKHQSEMEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLYGKLQHETRLKDDLEKVKHNLIEDHQKELNNAKQKTELMKQEFQRKET

SEQ ID NO: 57341 - protein, 3336 aa, Homo sapiens
MEVEQEQRRRKVEAGRTKLAHFRQRKTKGDSSHSEKKTAKRKGSAVDASVQEESPVTKEDSALCGGGDICKSTSCDDTPDGAGGAFAAQPEDCDGEKREDLEQLQQKQVNDHPPEQCGMFTVSDHPPEQHGMFTVGDHPPEQRGMFTVSDHPPEQHGMFTVSDHPPEQRGMFTISDHQPEQRGMFTVSDHTPEQRGIFTISDHPAEQRGMFTKECEQECELAITDLESGREDEAGLHQSQAVHGLELEALRLSLSNMHTAQLELTQANLQKEKETALTELREMLNSRRAQELALLQSRQQHELELLREQHAREKEEVVLRCGQEAAELKEKLQSEMEKNAQIVKTLKEDWESEKDLCLENLRKELSAKHQSEMEDLQNQFQKELAEQRAELEKIFQDKNQAERALRNLESHHQAAIEKLREDLQSEHGRCLEDLEFKFKESEKEKQLELENLQASYEDLKAQSQEEIRRLWSQLDSARTSRQELSELHEQLLARTSRVEDLEQLKQREKTQHESELEQLRIYFEKKLRDAEKTYQEDLTLLQQRLQGAREDALLDSVEVGLSCVGLEEKPEKGRKDHVDELEPERHKESLPRFQAELEESHRHQLEALESPLCIQHEGHVSDRCCVETSALGHEWRLEPSEGHSQELPWVHLQGVQDGDLEADTERAARVLGLETEHKVQLSLLQTELKEEIELLKIENRNLYGKLQHETRLKDDLEKVKHNLIEDHQKELNNAKQKTELMKQEFQRKETDWKVMKEELQREAEEKLTLMLLELREKAESEKQTIINKFELREAEMRQLQDQQAAQILDLERSLTEQQGRLQQLEQDLTSDDALHCSQCGREPPTAQDGELAALHVKEDCALQLMLARSRFLEERKEITEKFSAEQDAFLQEAQEQHARELQLLQERHQQQLLSVTAELEARHQAALGELTASLESKQGALLAARVAELQTKHAADLGALETRHLSSLDSLESCYLSEFQTIREEHRQALELLRADFEEQLWKKDSLHQTILTQELEKLKRKHEGELQSVRDHLRTEVSTELAGTVAHELQGVHQGEFGSEKKTALHEKEETLRLQSAQAQPFHQEEKESLSLQLQKKNHQVQQLKDQVLSLSHEIEECRSELEVLQQRRERENREGANLLSMLKADVNLSHSERGALQDALRRLLGLFGETLRAAVTLRSRIGERVGLCLDDAGAGLALSTAPALEETWSDVALPELDRTLSECAEMSSVAEISSHMRESFLMSPESVRECEQPIRRVFQSLSLAVDGLMEMALDSSRQLEEARQIHSRFEKEFSFKNEETAQVVRKHQELLECLKEESAAKAELALELHKTQGTLEGFKVETADLKEVLAGKEDSEHRLVLELESLRRQLQQAAQEQAALREECTRLWSRGEATATDAEAREAALRKEVEDLTKEQSETRKQAEKDRSALLSQMKILESELEEQLSQHRGCAKQAEAVTALEQQVASLDKHLRNQRQFMDEQAAEREHEREEFQQEIQRLEGQLRQAAKPQPWGPRDSQQAPLDGEVELLQQKLREKLDEFNELAIQKESADRQVLMQEEEIKRLEEMNINIRKKVAQLQEEVEKQKNIVKGLEQDKEVLKKQQMSSLLLASTLQSTLDAGRCPEPPSGSPPEGPEIQLEVTQRALLRRESEVLDLKEQLEKMKGDLESKNEEILHLNLKLDMQNSQTAVSLRELEEENTSLKVIYTRSSEIEELKATIENLQENQKRLQKEKAEEIEQLHEVIEKLQHELSLMGPVVHEVSDSQAGSLQSELLCSQAGGPRGQALQGELEAALEAKEALSRLLADQERRHSQALEALQQRLQGAEEAAELQLAELERNVALREAEVEDMASRIQEFEAALKAKEATIAERNLEIDALNQRKAAHSAELEAVLLALARIRRALEQQPLAAGAAPPELQWLRAQCARLSRQLQVLHQRFLRCQVELDRRQARRATAHTRVPGAHPQPRMDGGAKAQVTGDVEASHDAALEPVVPDPQGDLQPVLVTLKDAPLCKQEGVMSVLTVCQRQLQSELLLVKNEMRLSLEDGGKGKEKVLEDCQLPKVDLVAQVKQLQEKLNRLLYSMTFQNVDAADTKSLWPMASAHLLESSWSDDSCDGEEPDISPHIDTCDANTATGGVTDVIKNQAIDACDANTTPGGVTDVIKNWDSLIPDEMPDSPIQEKSECQDMSLSSPTSVLGGSRHQSHTAEAGPRKSPVGMLDLSSWSSPEVLRKDWTLEPWPSLPVTPHSGALSLCSADTSLGDRADTSLPQTQGPGLLCSPGVSAAALALQWAESPPADDHHVQRTAVEKDVEDFITTSFDSQETLSSPPPGLEGKADRSEKSDGSGFGARLSPGSGGPEAQTAGPVTPASISGRFQPLPEAMKEKEVRPKHVKALLQMVRDESHQILALSEGLAPPSGEPHPPRKEDEIQDISLHGGKTQEVPTACPDWRGDLLQVVQEAFEKEQEMQGVELQPRLSGSDLGGHSSLLERLEKIIREQGDLQEKSLEHLRLPDRSSLLSEIQALRAQLRMTHLQNQEKLQHLRTALTSAEARGSQQEHQLRRQVELLAYKVEQEKCIAGDLQKTLSEEQEKANSVQKLLAAEQTVVRDLKSDLCESRQKSEQLSRSLCEVQQEVLQLRSMLSSKENELKAALQELESEQGKGRALQSQLEEEQLRHLQRESQSAKALEELRASLETQRAQSSRLCVALKHEQTAKDNLQKELRIEHSRCEALLAQERSQLSELQKDLAAEKSRTLELSEALRHERLLTEQLSQRTQEACVHQDTQAHHALLQKLKEEKSRVVDLQAMLEKVQQQALHSQQQLEAEAQKHCEALRREKEVSATLKSTVEALHTQKRELRCSLEREREKPAWLQAELEQSHPRLKEQEGRKAARRSAEARQSPAAAEQWRKWQRDKEKLRELELQRQRDLHKIKQLQQTVRDLESKDEVPGSRLHLGSARRAAGSDADHLREQQRELEAMRQRLLSAARLLTSFTSQAVDRTVNDWTSSNEKAVMSLLHTLEELKSDLSRPTSSQKKMAAELQFQFVDVLLKDNVSLTKALSTVTQEKLELSRAVSKLEKLLKHHLQKGCSPSRSERSAWKPDETAPQSSLRRPDPGRLPPAASEEAHTSNVKMEKLYLHYLRAESFRKALIYQKKYLLLLIGGFQDSEQETLSMIAHLGVFPSKAERKITSRPFTRFRTAVRVVIAILRLRFLVKKWQEVDRKGALAQGKAPRPGPRARQPQSPPRTRESPPTRDVPSGHTRDPARGRRLAAAASPHSGGRATPSPNSRLERSLTASQDPEHSLTEYIHHLEVIQQRLGGVLPDSTSKKSCHPMIKQ

SEQ ID NO: 57342 - protein, 2024 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNMPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 57343 - protein, 529 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARENEEEDVRTIDSAVGSGSVAESTSLNIDVQSEASDTTARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKL

SEQ ID NO: 57344 - protein, 723 aa, Homo sapiens
MSSTCEPCKSRNRHSAQTEEPVQAKVFSRKNHEQLEKIIKCNRSTEISSAHARRILQQSNRNACNEAPETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 57345 - protein, 764 aa, Homo sapiens
  MOD_RES (1)..(1): Any amino acid
XKASAQASLASKDKTPKSKSKKRNSTQLKSRVKNIRYESASMSSTCEPCKSRNRHSAQTEEPVQAKVFSRKNHEQLEKIIKCNRSTEISSAHARRILQQSNRNACNEAPETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKNDQNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 57346 - protein, 408 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTNPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQ

SEQ ID NO: 57347 - protein, 522 aa, Homo sapiens
MAVNKGLTLLDGDLPEQENVLQRVLQLPVVSGTCECFQKTYTSTKEAHPLVASVCNAYEKGVQSASSLAAWSMEPVVRRLSTQFTAANELACRGLDHLEEKIPALQYPPEKIASELKDTISTRLRSARNSISVPIASTSDKVLGAALAGCELAWGVARDTAEFAANTRAGRLASGGADLALGSIEKVVEYLLPPDKEESAPAPGHQQAQKSPKAKPSLLSRVGALTNTLSRYTVQTMARALEQGHTVAMWIPGVVPLSSLAQWGASVAMQAVSRRRSEVRVPWLHSLAAAQEEDHEDQTDTEGEDTEEEEELETEENKFSEVAALPGPRGLLGGVAHTLQKTLQTTISAVTWAPAAVLGMAGRVLHLTPAPAVSSTKGRAMSLSDALKGVTDNVVDTVVHYVPLPRLSLMEPESEFRDIDNPPAEVERREAERRASGAPSAGPEPAPRLAQPRRSLRSAQSPGAPPGPGLEDEVATPAAPRPGFPAVPREKPKRRVSDSFFRPSVMEPILGRTHYSQLRKKS

SEQ ID NO: 57348 - protein, 522 aa, Homo sapiens; identical to SEQ ID NO: 57347

SEQ ID NO: 57349 - protein, 437 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVVSGSINTVLGSRMMQLVSSGVENALTKSELLVEQYLPLTEEELEKEAKKVEGFDLVQKPSYYVRLGSLSTKLHSRAYQQALSRVKEAKQKSQQTISQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVGPFYPQLTESQNAQDQGAEMDKSSQETQRSEHKTH

SEQ ID NO: 57350 - protein, 110 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQVSLGQKC

SEQ ID NO: 57351 - protein, 126 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQANTCFPNLDLDVCLKNNGHFLTS

SEQ ID NO: 57352 - protein, 356 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTGAKDSVASTITGVMDKTKGAVTGSVEKTKSVKKKQKKLKDLIWFRSQLHSTVHLIEFARKNVYSANQKIQDAQDKLYLSWVEWKRSIGYDDTDESHCAEHIESRTLAIARNLTQQLQTTCHTLLSNIQGVPQNIQDQAKHMGVMAGDIYSVFRNAASFKEVSDSLLTSSKGQLQKMKESLDDVMDYLVNNTPLNWLVGPFYPQLTESQNAQDQGAEMDKSSQETQRSEHKTH

SEQ ID NO: 57353 - protein, 125 aa, Homo sapiens
MASVAVDPQPSVVTRVVNLPLVSSTYDLMSSAYLSTKDQYPYLKSVCEMAENGVKTITSVAMTSALPIIQKLEPQIAVANTYACKGLDRIEERLPILNQPSTQIVANAKGAVTGAKDAVTTTVTG

SEQ ID NO: 57354 - protein, 434 aa, Homo sapiens
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQVLSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 57355 - protein, 422 aa, Homo sapiens
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSLGKLRATKQRAQEALLQLSQVLSLMETVKQGVDQKLVEGQEKLHQMWLSWNQKQLQGPEKEPPKPEQVESRALTMFRDIAQQLQATCTSLGSSIQGLPTNVKDQVQQARRQVEDLQATFSSIHSFQDLSSSILAQSRERVASAREALDHMVEYVAQNTPVTWLVGPFAPGITEKAPEEKK

SEQ ID NO: 57356 - protein, 463 aa, Homo sapiens
MSEEEAAQIPRSSVWEQDQQNVVQRVVALPLVRATCTAVCDVYSAAKDRHPLLGSACRLAENCVCGLTTRALDHAQPLLEHLQPQLATMNSLACRGLDKLEEKLPFLQQPSETVVTSAKDVVASSVTGVVDLARRGRRWSVELKRSVSHAVDVVLEKSEELVDHFLPMTEEELAALAAEAEGPEVGSVEDQRRQQGYFVRLGSLSARIRHLAYEHSVGKLRQSKHRAQDTLAQLQETLELIDHMQCGVTPTAPACPGKVHELWGEWGQRPPESRRRSQAELETLVLSRSLTQELQGTVEALESSVRGLPAGAQEKVAEVRRSVDALQTAFADARCFRDVPAAALAEGRGRVAHAHACVDELLELVVQAVPLPWLVGPFAPILVERPEPLPDLADLVDEVIGGPDPRWAHLDWPAQQRAWEAEHRDGSGNGDGDRMGVAGDICEQEPETPSCPVKHTLMPELDF

SEQ ID NO: 57357 - protein, 1255 aa, Homo sapiens
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHKELIKTLKELKVHLPADKKAKGKASTLATLKYALRSVKQVKANEEYYQLLMSSEGHPCGADVPSYTVEEMESVTSEHIVKNADMFAVAVSLVSGKILYISDQVASIFHCKRDAFSDAKFVEFLAPHDVGVFHSFTSPYKLPLWSMCSGADSFTQECMEEKSFFCRVSVRKSHENEIRYHPFRMTPYLVKVRDQQGAESQLCCLLLAERVHSGYEAPRIPPEKRIFTTTHTPNCLFQDVDERAVPLLGYLPQDLIETPVLVQLHPSDRPLMLAIHKKILQSGGQPFDYSPIRFRARNGEYITLDTSWSSFINPWSRKISFIIGRHKVRVGPLNEDVFAAHPCTEEKALHPSIQELTEQIHRLLLQPVPHSGSSGYGSLGSNGSHEHLMSQTSSSDSNGHEDSRRRRAEICKNGNKTKNRSHYSHESGEQKKKSVTEMQTNPPAEKKAVPAMEKDSLGVSFPEELACKNQPTCSYQQISCLDSVIRYLESCNEAATLKRKCEFPANVPALRSSDKRKATVSPGPHAGEAEPPSRVNSRTGVGTHLTSLALPGKAESVASLTSQCSYSSTIVHVGDKKPQPELEMVEDAASGPESLDCLAGPALACGLSQEKEPFKKLGLTKEVLAAHTQKEEQSFLQKFKEIRKLSIFQSHCHYYLQERSKGQPSERTAPGLRNTSGIDSPWKKTGKNRKLKSKRVKPRDSSESTGSGGPVSARPPLVGLNATAWSPSDTSQSSCPAVPFPAPVPAAYSLPVFPAPGTVAAPPAPPHASFTVPAVPVDLQHQFAVQPPPFPAPLAPVMAFMLPSYSFPSGTPNLPQAFFPSQPQFPSHPTLTSEMASASQPEFPSRTSIPRQPCACPATRATPPSAMGRASPPLFQSRSSSPLQLNLLQLEEAPEGGTGAMGTTGATETAAVGADCKPGTSRDQQPKAPLTRDEPSDTQNSDALSTSSGLLNLLLNEDLCSASGSAASESLGSGSLGCDASPSGAGSSDTSHTSKYFGSIDSSENNHKAKMNTGMEESEHFIKCVLQDPIWLLMADADSSVMMTYQLPSRNLEAVLKEDREKLKLLQKLQPRFTESQKQELREVHQWMQTGGLPAAIDVAECVYCENKEKGNICIPYEEDIPSLGLSEVSDTKEDENGSPLNHRIEEQT

SEQ ID NO: 57358 - protein, 404 aa, Homo sapiens
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHKELIKTLKELKVHLPADKKAKGKASTLATLKYALRSVKQVKANEEYYQLLMSSEGHPCGADVPSYTVEEMESVTSEHIVKNADMFAVAVSLVSGKILYISDQVASIFHCKRDAFSDAKFVEFLAPHDVGVFHSFTSPYKLPLWSMCSGADSFTQECMEEKSFFCRVSVRKSHENEIRYHPFRMTPYLVKVRDQQGAESQLCCLLLAERVHSGYEAPRIPPEKRIFTTTHTPNCLFQDVDESPAVRRAAFRLFSHSVSRPERRVHHVGHQLVQLHQPMEQENLLHHWEAQSQGGPFE

SEQ ID NO: 57359 - protein, 404 aa, Homo sapiens; identical to SEQ ID NO: 57358

SEQ ID NO: 57360 - protein, 109 aa, Homo sapiens
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHK

SEQ ID NO: 57361 - protein, 483 aa, Homo sapiens
MNGYAEFPPSPSNPTKEPVEPQPSQVPLQEDVDMSSGSSGHETNENCSTGRDSQGSDCDDSGKELGMLVEPPDARQSPDTFSLMMAKSEHNPSTSGCSSDQSSKVDTHKELIKTLKELKVHLPADKKAKGKASTLATLKYALRSVKQVKANEEYYQLLMSSEGHPCGADVPSYTVEEMESVTSEHIVKNADMFAVAVSLVSGKILYISDQVASIFHCKRDAFSDAKFVEFLAPHDVGVFHSFTSPYKLPLWSMCSGADSFTQECMEEKSFFCRVSVRKSHENEIRYHPFRMTPYLVKVRDQQGAESQLCCLLLAERVHSGYEAPRIPPEKRIFTTTHTPNCLFQDVDERAVPLLGYLPQDLIETPVLVQLHPSDRPLMLAIHKKILQSGGQPFDYSPIRFRARNGEYITLDTSWSSFINPWSRKISFIIGRHKVRVGPLNEDVFAAHPCTEEKALHPSIQELTEQIHRLLLQVGVVPACPPPR

SEQ ID NO: 57362 - protein, 779 aa, Homo sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYKPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 57363 - protein, 809 aa, Homo sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 57364 - protein, 836 aa, Homo sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEEVTKVTKFIEGGDGHLFEDEEIKRLLQGDTPVRKLQANKKVQGSRRRLREGRSQ

SEQ ID NO: 57365 - protein, 808 aa, Homo sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYTTKIITKVVEPKIKVIEGSLQPIIKTEGPTLTKVKIEGEPEFRLIKEGETITEVIHGEPIIKKYTKIIDGVPVEITEKETREERIITGPEIKYTRISTGGGETEETLKKLLQEDTPVRKLQANKKVQGSRRRLREGRSQ

SEQ ID NO: 57366 - protein, 277 aa, Homo sapiens
MRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNWCDPFD

SEQ ID NO: 57367 - protein, 781 aa, Homo sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYRPTLTKVKIEGEPEFRLIKEGETITEVIHGEPIIKKYTKIIDGVPVEITEKETREERIITGPEIKYTRISTGGGETEETLKKLLQEDTPVRKLQANKKVQGSRRRLREGRSQ

SEQ ID NO: 57368 - protein, 749 aa, Homo sapiens
MIPFLPMFSLLLLLIVNPINANNHYDKILAHSRIRGRDQGPNVCALQQILGTKKKYFSTCKNWYKKSICGQKTTVLYECCPGYMRMEGMKGCPAVLPIDHVYGTLGIVGATTTQRYSDASKLREEIEGKGSFTYFAPSNEAWDNLDSDIRRGLESNVNVELLNALHSHMINKRMLTKDLKNGMIIPSMYNNLGLFINHYPNGVVTVNCARIIHGNQIATNGVVHVIDRVLTQIGTSIQDFIEAEDDLSSFRAAAITSDILEALGRDGHFTLFAPTNEAFEKLPRGVLERIMGDKVASEALMKYHILNTLQCSESIMGGAVFETLEGNTIEIGCDGDSITVNGIKMVNKKDIVTNNGVIHLIDQVLIPDSAKQVIELAGKQQTTFTDLVAQLGLASALRPDGEYTLLAPVNNAFSDDTLSMDQRLLKLILQNHILKVKVGLNELYNGQILETIGGKQLRVFVYRTAVCIENSCMEKGSKQGRNGAIHIFREIIKPAEKSLHEKLKQDKRFSTFLSLLEAADLKELLTQPGDWTLFVPTNDAFKGMTSEEKEILIRDKNALQNIILYHLTPGVFIGKGFEPGVTNILKTTQGSKIFLKEVNDTLLVNELKSKESDIMTTNGVIHVVDKLLYPADTPVGNDQLLEILNKLIKYIQIKFVRGSTFKEIPVTVYSPEIKYTRISTGGGETEETLKKLLQEEVTKVTKFIEGGDGHLFEDEEIKRLLQGDTPVRKLQANKKVQGSRRRLREGRSQ

SEQ ID NO: 57369 - protein, 132 aa, Homo sapiens
MSNKFLGTWKLVSSENFDDYMKALGVGLATRKLGNLAKPTVIISKKGDIITIRTESTFKNTEISFKLGQEFEETTADNRKTKSIVTLQRGSLNQVQRWDGKETTIKRKLVNGKMVAECKMKGVVCTRIYEKV

SEQ ID NO: 57370 - protein, 160 aa, Homo sapiens
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSYGFAYILAWVAFPLALLSGVIYVILRKRE

SEQ ID NO: 57371 - protein, 118 aa, Homo sapiens
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAESNSSQMCGYRD

SEQ ID NO: 57372 - protein, 160 aa, Homo sapiens; identical to SEQ ID NO: 57370

SEQ ID NO: 57373 - protein, 149 aa, Homo sapiens
MLLLLLSIIVLHVAVLVLLFVSTIVSQWIVGNGHATDLWQNCSTSSSGNVHHCFSSSPNEWLQSVQATMILSIIFSILSLFLFFCQLFTLTKGGRFYITGIFQILAGLCVMSAAAIYTVRHPEWHLNSDYSFPLALLSGVIYVILRKRE

SEQ ID NO: 57374 - protein, 470 aa, Homo sapiens
MSHHPSGLRAGFSSTSYRRTFGPPPSLSPGAFSYSSSSRFSSSRLLGSASPSSSVRLGSFRSPRAGAGALLRLPSERLDFSMAEALNQEFLATRSNEKQELQELNDRFANFIEKVRFLEQQNAALRGELSQARGQEPARADQLCQQELRELRRELELLGRERDRVQVERDGLAEDLAALKQRLEEETRKREDAEHNLVLFRKDVDDATLSRLELERKIESLMDEIEFLKKLHEEELRDLQVSVESQQVQQVEVEATVKPELTAALRDIRAQYESIAAKNLQEAEEWYKSKYADLSDAANRNHEALRQAKQEMNESRRQIQSLTCEVDGLRGTNEALLRQLRELEEQFALEAGGYQAGAARLEEELRQLKEEMARHLREYQELLNVKMALDIEIATYRKLLEGEESRISVPVHSFASLNIKTTVPEVEPPQDSHSRKTVLIKTIETRNGEVVTESQKEQRSELDKSSAHSY

SEQ ID NO: 57375 - protein, 346 aa, Homo sapiens
MALLKVKFDQKKRVKLAQGLWLMNWFSVLAGIIIFSLGLFLKIELRKRSDVMNNSESHFVPNSLIGMGVLSCVFNSLAGKICYDALDPAKYARWKPWLKPYLAICVLFNIILFLVALCCFLLRGSLENTLGQGLKNGMKYYRDTDTPGRCFMKKTIDMLQIEFKCCGNNGFRDWFEIQWISNRYLDFSSKEVKDRIKSNVDGRYLVDGVPFSCCNPSSPRPCIQYQITNNSAHYSYDHQTEELNLWVRGCRAALLSYYSSLMNSMGVVTLLIWLFEVTITIGLRYLQTSLDGVSNPEESESESQGWLLERSVPETWKAFLESVKKLGKGNQVEAEGADAGQAPEAG

SEQ ID NO: 57376 - protein, 367 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 57377 - protein, 458 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIESAGQTWQQVPPVRNTEMDHDGTPENEGEETAQSAPQPPQAPQPLQPRKKRVRRTTQLRRTTGAPDITWGMLKKTTQEAERILLRTQTPFTPENLFLAMLSVVHCNSRKDVKPENKQ

SEQ ID NO: 57378 - protein, 374 aa, Homo sapiens
MAYRRDEMWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 57379 - protein, 434 aa, Homo sapiens
MWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIESAGQTWQQVPPVRNTEMDHDGTPENEGEETAQSALFGFQHDASNHTIVGLGPNQVPEMKETTLQAPQPPQAPQPLQPRKKRVRRTTQLRRTTGAPDITWGMLKKTTQEAERILLRTQTPFTPENLFLAMLSVVHCNSRKDVKPENKQ

SEQ ID NO: 57380 - protein, 348 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQHRNKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 57381 - protein, 161 aa, Homo sapiens
MAYRRDEMWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSY

SEQ ID NO: 57382 - protein, 168 aa, Homo sapiens
MWSEGRYEYERIPRERAPPRSHPSDGYNRLVNIVPKKPPLLDRPGEGSYNRYYSHVDYRDYDEGRSFSHDRRSGPPHRGDESGYRWTRDDHSASRQPEYRDMRDGFRRKSFYSSHYARERSPYKRDNTFFRESPVGRKDSPHSRSGSSVSSRSYSPERSKSYSFHQSQ

SEQ ID NO: 57383 - protein, 319 aa, Homo sapiens
MAYRRDEMWSEGRYEYERIPRERAPPRSHPSDESGYRWTRDDHSASRQPEYRDMRDGFRRKSFYSSHYARERSPYKRDNTFFRESPVGRKDSPHSRSGSSVSSRSYSPERSKSYSFHQSQHRKSVRPGASYKRQNEGNPERDKERPVQSLKTSRDTSPSSGSAVSSSKVLDKPSRLTEKELAEAASKWAAEKLEKSDESNLPEISEYEAGSTAPLFTDQPEEPESNTTHGIELFEDSQLTTRSKAIASKTKEIEQVYRQDCETFGMVVKMLIEKDPSLEKSIQFALRQNLHEIGERCVEELKHFIAEYDTSTQDFGEPF

SEQ ID NO: 57384 - protein, 1756 aa, Homo sapiens
MNSLFRKRNKGKYSPTVQTRSISNKELSELIEQLQKNADQVEKNIVDTEAKMQSDLARLQEGRQPEHRDVTLQKVLDSEKLLYVLEADAAIAKHMKHPQGDMIAEDIRQLKERVTNLRGKHKQIYRLAVKEVDPQVNWAALVEEKLDKLNNQSFGTDLPLVDHQVEEHNIFHNEVKAIGPHLAKDGDKEQNSELRAKYQKLLAASQARQQHLSSLQDYMQRCTNELYWLDQQAKGRMQYDWSDRNLDYPSRRRQYENFINRNLEAKEERINKLHSEGDQLLAAEHPGRNSIEAHMEAVHADWKEYLNLLICEESHLKYMEDYHQFHEDVKDAQELLRKVDSDLNQKYGPDFKDRYQIELLLRELDDQEKVLDKYEDVVQGLQKRGQQVVPLKYRRETPLKPIPVEALCDFEGEQGLISRGYSYTLQKNNGESWELMDSAGNKLIAPAVCFVIPPTDPEALALADSLGSQYRSVRQKAAGSKRTLQQRYEVLKTENPGDASDLQGRQLLAGLDKVASDLDRQEKAITGILRPPLEQGRAVQDSAERAKDLKNITNELLRIEPEKTRSTAEGEAFIQALPGSGTTPLLRTRVEDTNRKYEHLLQLLDLAQEKVDVANRLEKSLQQSWELLATHENHLNQDDTVPESSRVLDSKGQELAAMACELQAQKSLLGEVEQNLQAAKQCSSTLASRFQEHCPDLERQEAEVHKLGQRFNNLRQQVERRAQSLQSAKAAYEHFHRGHDHVLQFLVSIPSYEPQETDSLSQMETKLKNQKNLLDEIASREQEVQKICANSQQYQQAVKDYELEAEKLRSLLDLENGRRSHVSKRARLQSPATKVKEEEAALAAKFTEVYAINRQRLQNLEFALNLLRQQPEVEVTHETLQRNRPDSGVEEAWKIRKELDEETERRRQLENEVKSTQEEIWTLRNQGPQESVVRKEVLKKVPDPVLEESFQQLQRTLAEEQHKNQLLQEELEALQLQLRALEQETRDGGQEYVVKEVLRIEPDRAQADEVLQLREELEALRRQKGAREAEVLLLQQRVAALAEEKSRAQEKVTEKEVVKLQNDPQLEAEYQQLQEDHQRQDQLREKQEEELSFLQDKLKRLEKERAMAEGKITVKEVLKVEKDAATEREVSDLTRQYEDEAAKARASQREKTELLRKIWALEEENAKVVVQEKVREIVRPDPKAESEVANLRLELVEQERKYRGAEEQLRSYQSELEALRRRGPQVEVKEVTKEVIKYKTDPEMEKELQRLREEIVDKTRLIERCDLEIYQLKKEIQALKDTKPQVQTKEVVQEILQFQEDPQTKEEVASLRAKLSEEQKKQVDLERERASQEEQIARKEEELSRVKERVVQQEVVRYEEEPGLRAEASAFAESIDVELRQIDKLRAELRRLQRRRTELERQLEELERERQARREAEREVQRLQQRLAALEQEEAEAREKVTHTQKVVLQQDPQQAREHALLRLQLEEEQHRRQLLEGELETLRRKLAALEKAEVKEKVVLSESVQVEKGDTEQEIQRLKSSLEEESRSKRELDVEVSRLEARLSELEFHNSKSSKELDFLREENHKLQLERQNLQLETRRLQSEINMAATETRDLRNMTVADSGTNHDSRLWSLERELDDLKRLSKDKDLEIDELQKRLGSVAVKREQRENHLRRSIVVIHPDTGRELSPEEAHRAGLIDWNMFVKLRSQECDWEEISVKGPNGESSVIHDRKSGKKFSIEEALQSGRLTPAQYDRYVNKDMSIQELAVLVSGQK

SEQ ID NO: 57385 - protein, 1479 aa, Homo sapiens
MAKRSRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSYHYNDLVSPQYLNLIANLSGCTAHRRVNNCSDMCFHQKYRTHDGTCNNLQHPMWGASLTAFERLLKSVYENGFNTPRGINPHRLYNGHALPMPRLVSTTLIGTETVTPDEQFTHMLMQWGQFLDHDLDSTVVALSQARFSDGQHCSNVCSNDPPCFSVMIPPNDSRARSGARCMFFVRSSPVCGSGMTSLLMNSVYPREQINQLTSYIDASNVYGSTEHEARSIRDLASHRGLLRQGIVQRSGKPLLPFATGPPTECMRDENESPIPCFLAGDHRANEQLGLTSMHTLWFREHNRIATELLKLNPHWDGDTIYYETRKIVGAEIQHITYQHWLPKILGEVGMRTLGEYHGYDPGINAGIFNAFATAAFRFGHTLVNPLLYRLDENFQPIAQDHLPLHKAFFSPFRIVNEGGIDPLLRGLFGVAGKMRVPSQLLNTELTERLFSMAHTVALDLAAINIQRGRDHGIPPYHDYRVYCNLSAAHTFEDLKNEIKNPEIREKLKRLYGSTLNIDLFPALVVEDLVPGSRLGPTLMCLLSTQFKRLRDGDRLWYENPGVFSPAQLTQIKQTSLARILCDNADNITRVQSDVFRVAEFPHGYGSCDEIPRVDLRVWQDCCEDCRTRGQFNAFSYHFRGRRSLEFSYQEDKPTKKTRPRKIPSVGRQGEHLSNSTSAFSTRSDASGTNDFREFVLEMQKTITDLRTQIKKLESRLSTTECVDAGGESHANNTKWKKDACTICECKDGQVTCFVEACPPATCAVPVNIPGACCPVCLQKRAEEKP

SEQ ID NO: 57386 - protein, 723 aa, Homo sapiens
  MOD_RES (1)..(1): Any amino acid
XRGPGRRCLLALVLFCAWGTLAVVAQKPGAGCPSRCLCFRTTVRCMHLLLEAVPAVAPQTSILDLRFNRIREIQPGAFRRLRNLNTLLLNNNQIKRIPSGAFEDLENLKYLYLYKNEIQSIDRQAFKGLASLEQLYLHFNQIETLDPDSFQHLPKLERLFLHNNRITHLVPGTFNHLESMKRLRLDSNTLHCDCEILWLADLLKTYAESGNAQAAAICEYPRRIQGRSVATITPEELNCERPRITSEPQDADVTSGNTVYFTCRAEGNPKPEIIWLRNNNELSMKTDSRLNLLDDGTLMIQNTQETDQGIYQCMAKNVAGEVKTQEVTLRYFGSPARPTFVIQPQNTEVLVGESVTLECSATGHPPPRISWTRGDRTPLPVDPRVNITPSGGLYIQNVVQGDSGEYACSATNNIDSVHATAFIIVQALPQFTVTPQDRVVIEGQTVDFQCEAKGNPPPVIAWTKGGSQLSVDRRHLVLSSGTLRISGVALHDQGQYECQAVNIIGSQKVVAHLTVQPRVTPVFASIPSDTTVEVGANVQLPCSSQGEPEPAITWNKDGVQVTESGKFHISPEGFLTINDVGPADAGRYECVARNTIGSASVSMVLSVNVPDVSRNGDPFVATSIVEAIATVDRAINSTRTHLFDSRPRSPNDLLALFRYPRDPYTVEQARAGEIFERTLQLIQEHVQHGLMVDLNGTSQCQSLFFLLHGLSNGVEHASVKSHS

SEQ ID NO: 57387 - protein, 256 aa, Homo sapiens
MAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 57388 - protein, 238 aa, Homo sapiens
MAAAVGRLLRASVARHVSAIPWGISATAALRPAACGRTSLTNLLCSGSSQAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVNQ

SEQ ID NO: 57389 - protein, 214 aa, Homo sapiens
MGLAGVCALRRSAGYILVGGAGGQSAAAAARRYSEGEWASGGVRSFSRAAAAMAPIKVGDAIPAVEVFEGEPGNKVNLAELFKGKKGVLFGVPGAFTPGCSKTHLPGFVEQAEALKAKGVQVVACLSVNDAFVTGEWGRAHKAEGKVRLLADPTGAFGKETDLLLDDSLVSIFGNRRLKRFSMVVQDGIVKALNVEPDGTGLTCSLAPNIISQL

SEQ ID NO: 57390 - protein, 125 aa, Homo sapiens
MGLAGVCALRRSAGYILVGGAGGQSAAAAARRYSEGEWASGGVRSFSRAAAAMAPIKVRLLADPTGAFGKETDLLLDDSLVSIFGNRRLKRFSMVVQDGIVKALNVEPDGTGLTCSLAPNIISQL

SEQ ID NO: 57391 - protein, 170 aa, Homo sapiens
MGLAGVCALRRSAGYILVGGAGGQSAAAAARRYSEGEWASGGVRSFSRAAAAMAPIKVGDAIPAVEVFEGEPGNKVNLAELFKGKKGVLFGVPGAFTPGCSKVRLLADPTGAFGKETDLLLDDSLVSIFGNRRLKRFSMVVQDGIVKALNVEPDGTGLTCSLAPNIISQL

SEQ ID NO: 57392 - protein, 224 aa, Homo sapiens
MPGGLLLGDVAPNFEANTTVGRIRFHDFLGDSWGILFSHPRDFTPVCTTELGRAAKLAPEFAKRNVKLIALSIDSVEDHLAWSKDINAYNCEEPTEKLPFPIIDDRNRELAILLGMLDPAEKDEKGMPVTARVVFVFGPDKKLKLSILYPATTGRNFDEILRVVISLQLTAEKRVATPVDWKDGDSVMVLPTIPEEEAKKLFPKGVFTKELPSGKKYLRYTPQP

SEQ ID NO: 57393 - protein, 1283 aa, Homo sapiens
MWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 57394 - protein, 1226 aa, Homo sapiens
MWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKALRALNDMIKEFISMGSLVALIATSQSQQSLHPLLVSAQGVHIFQCVQHIQPPNQEQRCEILCNVIKNKLDCDINKFTDLDLQHVAKETGGFVARDFTVLVDRAIHSRLSRQSISTREKLVLTTLDFQKALRGFLPASLRSVNLHKPRDLGWDKIGGLHEVRQILMDTIQLPAKYPELFANLPIRQRTGILLYGPPGTGKTLLAGVIARESRMNFISVKGPELLSKYIGASEQAVRDIFIRAQAAKPCILFFDEFESIAPRRGHDNTGVTDRVVNQLLTQLDGVEGLQGVYVLAATSRPDLIDPALLRPGRLDKCVYCPPPDQVSRLEILNVLSDSLPLADDVDLQHVASVTDSFTGADLKALLYNAQLEALHGMLLSSGLQDGSSSSDSDLSLSSMVFLNHSSGSDDSAGDGECGLDQSLVSLEMSEILPDESKFNMYRLYFGSSYESELGNGTSSDLSSQCLSAPSSMTQDLPGVPGKDQLFSQPPVLRTASQEGCQELTQEQRDQLRADISIIKGRYRSQSGEDESMNQPGPIKTRLAISQSHLMTALGHTRPSISEDDWKNFAELYESFQNPKRRKNQSGTMFRPGQKVTLA

SEQ ID NO: 57395 - protein, 160 aa, Homo sapiens
MSLVAGLRNGALLLTGGKGSGKSTLAKAICKEAFDKLDAHVERVDCKALRGKRLENIQKTLEVAFSEAVWMQPSVVLLDDLDLIAGLPAVPEHEHSPDAVQSQRLAHALNDMIKEFISMGSLVALIATSQSQQSLHPLLVSAQGVHIFQCVQHIQPPNQN

SEQ ID NO: 57396 - protein, 632 aa, Homo sapiens
MWGSDRLAGAGGGGAAVTVAFTNARDCFLHLPRRLVAQLHLLQNQAIEVVWSHQPAFLSWVEGRHFSDQGENVAEINRQVGQKLGLSNGGQVFLKPCSHVVSCQQVEVEPLSADDWEILELHAVSLEQHLLDQIRIVFPKAIFPVWVDQQTYIFIQIVALIPAASYGRLETDTKLLIQPKTRRAKENTFSKADAEYKKLHSYGRDQKGMMKELQTKQLQSNTVGITESNENESEIPVDSSSVASLWTMIGSIFSFQSEKKQETSWGLTEINAFKNMQSKVVPLDNIFRVCKSQPPSIYNASATSVFHKHCAIHVFPWDQEYFDVEPSFTVTYGKLVKLLSPKQQQSKTKQNVLSPEKEKQMSEPLDQKKIRSDHNEEDEKACVLQVVWNGLEELNNAIKYTKNVEVLHLGKVWIPDDLRKRLNIEMHAVVRITPVEVTPKIPRSLKLQPRENLPKDISEEDIKTVFYSWLQQSTTTMLPLVISEEEFIKLETKDGLKEFSLSIVHSWEKEKDKNIFLLSPNLLQKTTIQVLLDPMVKEENSEEIDFILPFLKLSSLGGVNSLGVSSLEHITHSLLGRPLSRQLMSLVAGLRNGALLLTGGKGSGKSTLAKAICKEAFDKLDAHVERVDCKAL

SEQ ID NO: 57397 - protein, 346 aa, Homo sapiens
MAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYQALRPDPLRVLMSVAPSALQLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 57398 - protein, 326 aa, Homo sapiens
MAPAAASPPEVIRAAQKDEYYRGGLRSAAGGALHSLAGARKWLEWRKEVELLSDVAYFGLTTLAGYQTLGEEYVSIIQVDPSRIHVPSSLRRGVLVTLHAVLPYLLDKALLPLEQELQADPDSGRPLQGSLGPGGRGCSGARRWMRHHTATLTEQQRRALLRAVFVLRQGLACLQRLHVAWFYIHGVFYHLAKRLTGITYLRVRSLPGEDLRARVSYRLLGVISLLHLVLSMGLQLYGFRQRQRARKEWRLHRGLSHRRASLEERAVSRNPLCTLCLEERRHPTATPCGHLFCWECITAWCSSKAECPLCREKFPPQKLIYLRHYR

SEQ ID NO: 57399 - protein, 247 aa, Homo sapiens
MDAFTRFTNQTQGRDRLFRATQYTCMLLRYLLEPKAGKEKVVMKLKKLESSVSTGRKWFRLGNVVHAIQATEQSIHATDLVPRLCLTLANLNRVIYFICDTILWVRSVGLTSGINKEKWRTRAAHHYYYSLLLSLVRDLYEISLQMKRVTCDRAKKEKSASQDPLWFSVAEEETEWLQSFLLLLFRSLKQHPPLLLDTVKNLCDILNPLDQLGIYKSNPGIIGLGGLVSSIAGMITVAYPQMKLKTR

SEQ ID NO: 57400 - protein, 241 aa, Homo sapiens
MASLSGLASALESYRGRDRLIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTSPLPRGKRRAMEAQMQSEALSLLSNLADLANAVHWLPRGVLWAGRFPPWLVGLMGTISSILSMYQAARAGGQAEATTP

SEQ ID NO: 57401 - protein, 168 aa, Homo sapiens
  MOD_RES (1)..(1): Any amino acid
XYRGRDRLIRVLGYCCQLVGGVLVEQCPARSEVGTRLLVVSTQLSHCRTILRLFDDLAMFVYTKQYGLGAQEEDAFVRCVSVLGNLADQLYYPCEHVAWAADARVLHVDSSRWWTLSTTLWALSLLLGVARSLWMLLKLRQRLRSPTAPFTSMYQAARAGGQAEATTP

SEQ ID NO: 57402 - protein, 403 aa, Homo sapiens
MASQPPPPPKPWETRRIPGAGPGPGPGPTFQSADLGPTLMTRPGQPALTRVPPPILPRPSQQTGSSSVNTFRPAYSSFSSGYGAYGNSFYGGYSPYSYGYNGLGYNRLRVDDLPPSRFVQQAEESSRGAFQSIESIVHAFASVSMMMDATFSAVYNSFRAVLDVANHFSRLKIHFTKVFSAFALVRTIRYLYRRLQRMLGLRRGSENEDLWAESEGTVACLGAEDRAATSAKSWPIFLFFAVILGGPYLIWKLLSTHSDEVTDSINWASGEDDHVVARAEYDFAAVSEEEISFRAGDMLNLALKEQQPKVRGWLLASLDGQTTGLIPANYVKILGKRKGRKTVESSKVSKQQQSFTNPTLTKGATVADSLDEQEAAFESVFVETNKVPVAPDSIGKDGEKQDL

SEQ ID NO: 57403 - protein, 377 aa, Homo sapiens
MASSEQAEQPSQPSSTPGSENVLPREPLIATAVKFLQNSRVRQSPLATRRAFLKKKGLTDEEIDMAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 57404 - protein, 313 aa, Homo sapiens
MAFQQSGTAADEPSSLGPATQVVPVQPPHLISQPYSPAGSRWRDYGALAIIMAGIAFGFHQLYKKYLLPLILGGREDRKQLERMEAGLSELSGSVAQTVTQLQTTLASVQELLIQQQQKIQELAHELAAAKATTSTNWILESQNINELKSEINSLKGLLLNRRQFPPSPSAPKIPSWQIPVKSPSPSSPAAVNHHSSSDISPVSNESTSSSPGKEGHSPEGSTVTYHLLGPQEEGEGVVDVKGQVRMEVQGEEEKREDKEDEEDEEDDDVSHVDEEDCLGVQREDRRGGDGQINEQVEKLRRPEGASNESERD

SEQ ID NO: 57405 - protein, 346 aa, Homo sapiens
MEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALVQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTTSQRAASPCLPARPHTQPWSPPAFLPGHP

SEQ ID NO: 57406 - protein, 336 aa, Homo sapiens
MEKLRLLGLRYQEYVTRHPAATAQLETAVRGFSYLLAGRFADSHELSELVYSASNLLVLLNDGILRKELRKKLPVSLSQQKLLTWLSVLECVEVFMEMGAAKVWGEVGRWLVIALVQLAKAVLRMLLLLWFKAGLQTSPPIVPLDRETQAQPPDGDHSPGNHEQSYVGKRSNRVVRTLQNTPSLHSRHWGAPQQREGRQQQHHEELSATPTPLGLQETIAEFLYIARPLLHLLSLGLWGQRSWKPWLLAGVVDVTSLSLLSDRKGLTRRERRELRRRTILLLYYLLRSPFYDRFSEARILFLLQLLADHVPGVGLVTRPLMDYLPTWQKIYFYSWG

SEQ ID NO: 57407 - protein, 299 aa, Homo sapiens
MAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 57408 - protein, 235 aa, Homo sapiens
MESGALDDFDKAKPSPAPPSTTTAPDASGPQKRSPGDTAKDALFASQEKFFQELFDSELASQATAEFEKAMKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLM

SEQ ID NO: 57409 - protein, 279 aa, Homo sapiens [sequence omitted]

SEQ ID NO: 57410 - protein, 209 aa, Homo sapiens
MKELAEEEPHLVEQFQKLSEAAGRVGSDMTSQQEFTSCLKETLSGLAKNATDLQNSSMSEEELTKAMEGLGMDEGDGEGNILPIMQSIMQNLLSKDVLYPSLKEITEKYPEWLQSHRESLPPEQFEKYQEQHSVMCKICEQFEAETPTDSETTQKARFEMVLDLMQQLQDLGHPPKELAGEMPPGLNFDLDALNLSGPPGASGEQCLIM

SEQ ID NO: 57411 - protein, 186 aa, Homo sapiens
MAAAEEGCSVGAEADRELEELLESALDDFDKAKPSPAPPSTTTAPDASGPQKRSPGDTAKDALFASQEKFFQELFDSELASQATAEFEKAMKELAEEEPHLVEQFQKLSEAAGRVELQHVGRRADQGHGGARHGRRGWGREHPPHHAEYYAEPTLQGCAVPITEGDHRKVSRMVAESSGISTSRAV

SEQ ID NO: 57412 - protein, 305 aa, Homo sapiens
MASRKENAKSANRVLRISQLDALELNKALEQLVWSQFTQCFHGFKPGLLARFEPEVKACLWVFLWRFTIYSKNATVGQSVLNIKYKNDFSPNLRYQPPSKNQKIWYAVCTIGGRWLEERCYDLFRNHHLASFGKVKQCVNFVIGLLKLGGLINFLIFLQRGKFATLTERLLGIHSVFCKPQNICEVGFEYMNRELLWHGFAEFLIFLLPLINVQKLKAKLSSWCIPLTGAPNSDNTLATSGKECALCGEWPTMPHTIGCEHIFCYFCAKSSFLFDVYFTCPKCGTEVHSLQPLKSGIEMSEVNAL

SEQ ID NO: 57413 - protein, 305 aa, Homo sapiens; identical to SEQ ID NO: 57412

SEQ ID NO: 57414 - protein, 180 aa, Homo sapiens
MASRKENAKSANRVLRISQLDALELNKALEQLVWSQFTQCFHGFKPGLLARFEPEVKACLWVFLWRFTIYSKNATVGQSVLNIKYKNDFSPNLRYQPPSKNQKIWYAVCTIGGRWLEERCYDLFRNHHLASFGKVKQCVNFVIGLLKLGGLINFLIFLQRGKFATLTERLLGIHSVFCKP

SEQ ID NO: 57415 - protein, 3 aa, Homo sapiens
MAS

SEQ ID NO: 57416 - protein, 305 aa, Homo sapiens; identical to SEQ ID NO: 57412

SEQ ID NO: 57417 - protein, 305 aa, Homo sapiens; identical to SEQ ID NO: 57412

SEQ ID NO: 57418 - protein, 305 aa, Homo sapiens
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAQKPNLEGSVSHKFLSLPMLVRQLWDSAVSHFFSLPFKKSLLAALILCLLVVRFDPASPSSLHFLYKLAQLFRWIRKAAFSRLYQLRIRD

SEQ ID NO: 57419 - protein, 305 aa, Homo sapiens; identical to SEQ ID NO: 57418

SEQ ID NO: 57420 - protein, 365 aa, Homo sapiens
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAQKPNLEGSVSHKFLSLPMLVRQLWDSAVSHFFSLPFKKSLLAALILCLLVVRFDPASPSSLHFLYKLAQLFAGSGRLHFLASTSSASVTEGPCAPQPLCSSRPWPQKQSDRATHPQAPLGKWDQPNLAECTVSCCLGALSFAPYFGWSR

SEQ ID NO: 57421 - protein, 256 aa, Homo sapiens
MKSDSSTSAAPLRGLGGPLRSSEPVRAVPARAPAVDLLEEAADLLVVHLDFRAALETCERAWQSLANHAVAEEPAGTSLEVKCSLCVVGIQALAEMDRWQEVLSWVLQYYQVPEKLPPKVLELCILLYSKMQEPGAVLDVVGAWLQDPANQNLPEYGALAEFHVQRVLLPLGCLSEAEELVVGSAAFGEERRLDVLQAIHTARQQQKQEHSGSEEAQKPNLEASPSSLHFLYKLAQLFRWIRKAAFSRLYQLRIRD

SEQ ID NO: 57422 - protein, 182 aa, Homo sapiens
MLRSVWNFLKRHKKKCIFLGTVLGVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWIN

SEQ ID NO: 57423 - protein, 373 aa, Homo sapiens
MLRSVWNFLKRHKKKCIFLGTVLGGVYILGKYGQKKIREIQEREAAEYIAQARRQYHFESNQRTCNMTVLSMLPTLREALMQQLNSESLTALLKNRPSNKLEIWEDLKIISFTRSTVAVYSTCMLVVLLRVQLNIIGGYIYLDNAAVGKNGTTILAPPDVQQQYLSSIQHLLGDGLTELITVIKQAVQKVLGSVSLKHSLSLLDLEQKLKEIRNLVEQHKSSSWINKDGSKPLLCHYMMPDEETPLAVQACGLSPRDITTIKLLNETRDMLESPDFSTVLNTCLNRGFSRLLDNMAEFFRPTEQDLQHGNSMNSLSSVSLPLAKIIPIVNGQIHSVCSETPSHFVQDLLTMEQVKDFAANVYEAFSTPQQLEK

SEQ ID NO: 57424 - protein, 182 aa, Homo sapiens; identical to SEQ ID NO: 57422

SEQ ID NO: 57425 - protein, 602 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 57426 - protein, 631 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIELQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 57427 - protein, 410 aa, Homo sapiens
MAMRELVEAECGGANPLMKLAGHFTQDKALRQEGLRPGPWPPGAPASEAVSVLEVESPGAASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEGTSDAWVDQFTRPVNTSALDMEFERAKSAIELQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLV

SEQ ID NO: 57428 - protein, 660 aa, Homo sapiens
MLLCRAHRVLGLRGARELAVTMAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 57429 - protein, 639 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 57430 - protein, 654 aa, Homo sapiens
MAMRELVEAECGGANPLMKLAGHFTQDKALRQEGLRPGPWPPGAPASEAVSVLEVESPGAASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFIQQQGTSDAWVDQFTRPVNTSALDMEFERAKSAIESDVDFWDKLQAELEEMAKRDAEAHPWLSDYDDLTSATYDKGYQFEEENPLRDHPQPFEEGLRRLQEGDLPNAVLLFEAAVQQDPKHMEAWQYLGTTQAENEQELLAISALRRCLELKPDNQTALMALAVSFTNESLQRQACETLRDWLRYTPAYAHLVTPAEEGAGGAGLGPSKRILGSLLSDSLFLEVKELFLAAVRLDPTSIDPDVQCGLGVLFNLSGEYDKAVDCFTAALSVRPNDYLLWNKLGATLANGNQSEEAVAAYRRALELQPGYIRSRYNLGISCINLGAHREAVEHFLEALNMQRKSRGPRGEGGAMSENIWSTLRLALSMLGQSDAYGAADARDLSTLLTMFGLPQ

SEQ ID NO: 57431 - protein, 639 aa, Homo sapiens; identical to SEQ ID NO: 57429

SEQ ID NO: 57432 - protein, 114 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLAL

SEQ ID NO: 57433 - protein, 102 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQA

SEQ ID NO: 57434 - protein, 248 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQRAPGVADLALSENWAQEFLAAGDAVDVTQDYNETDWSQEFISEVTDPLSVSPARWAEEYLEQSEEKLWLGEPEGTATDRWYDEYHPEEDLQHTASDFVAKVDDPKLANSEFLKFVRQIGEGQVSLESGAGSGRAQAEQWAAEFI

SEQ ID NO: 57435 - protein, 104 aa, Homo sapiens
MAMRELVEAECGGANPLMKLAGHFTQDKALRQEGLRPGPWPPGAPASEAASKPLGVASEDELVAEFLQDQNAPLVSRAPQTFKMDDLLAEMQQIEQSNFRQAPQ

SEQ ID NO: 57436 - protein, 624 aa, Homo sapiens
MYQGHMQVVGVTLKKKWHCLQKSDLTLALGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 57437 - protein, 624 aa, Homo sapiens
MHQNGSQVVGVTLKKKWHCLQKSDLTLALGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 57438 - protein, 518 aa, Homo sapiens
MVMKEIPREESAEEKPLLTMTSQLVNEQQESRPLLSPSIDDFLCETKSEAIARPVTSNTADIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 57439 - protein, 602 aa, Homo sapiens
MYQGHMQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 57440 - protein, 514 aa, Homo sapiens
MSSLSLKPLVQVSVGAFVQLVNEQQESRPLLSPSIDDFLCETKSEAIARPVTSNTADIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 57441 - protein, 626 aa, Homo sapiens
MYQGHMQKSKEQGYGKLSSDEDLEIIVDQKQGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 57442 - protein, 583 aa, Homo sapiens
MVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 57443 - protein, 591 aa, Homo sapiens
MYQGHMQKSKEQGYGKLSSDEDLEIIVDQKQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEDYSLWNRLGATLANGDRSEEAVEAYTRALEIQPGFIRSRYNLGISCINLGAYREAVSNFLTALSLQRKSRNQQQVPHPAISGNIWAALRIALSLMDQPELFQAANLGDLDVLLRAFNLDP

SEQ ID NO: 57444 - protein, 738 aa, Homo sapiens
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKVETKSLECLPGPGLQLHALSSLMNWTLWPQAGGEVEILEE

SEQ ID NO: 57445 - protein, 980 aa, Homo sapiens
MALAVLRVLEPFPTETPPLAVLLPPGGPWPAAELGLVLALRPAGESPAGPALLVAALEGPDAGTEEQGPGPPQLLVSRALLRLLALGSGAWVRARAVRRPPALGWALLGTSLGPGLGPRVGPLLVRRGETLPVPGPRVLETRPALQGLLGPGTRLAVTELRGRARLCPESGDSSRPPPPPVVSSFAVSGTVRRLQGVLGGTGDSLGVSRSCLRGLGLFQGEWVWVAQARESSNTSQPHLARVQVLEPRWDLSDRLGPGSGPLGEPLADGLALVPATLAFNLGCDPLEMGELRIQRYLEGSIAPEDKGSCSLLPGPPFARELHIEIVSSPHYSTNGNYDGVLYRHFQIPRVVQEGDVLCVPTIGQVEILEGSPEKLPRWREMFFKVKKTVGEAPDGPASAYLADTTHTSLYMVGSTLSPVPWLPSEESTLWSSLSPPGLEALVSELCAVLKPRLQPGGALLTGTSSVLLRGPPGCGKTTVVAAACSHLGLHLLKVPCSSLCAESSGAVETKLQAIFSRARRCRPAVLLLTAVDLLGRDRDGLGEDARVMAVLRHLLLNEDPLNSCPPLMVVATTSRAQDLPADVQTAFPHELEVPALSEGQRLSILRALTAHLPLGQEVNLAQLARRCAGFVVGDLYALLTHSSRAACTRIKNSGLAGGLTEEDEGELCAAGFPLLAEDFGQALEQLQTAHSQAVGAPKIPSVSWHDVGGLQEVKKEILETIQLPLEHPELLSLGLRRSGLLLHGPPGTGKTLLAKAVATECSLTFLSVKGPELINMYVGQSEENVREVFARARAAAPCIIFFDELDSLAPSRGRSGDSGGVMDRVVSQLLAELDGLHSTQDVFVIGATNRPDLLDPALLRPGRFDKLVFVGANEDRASQLRVLSAITRKFKLEPSVSLVNVLDCCPPQLTGADLYSLCSDAMTAALKRRVHDLEEGLEPGSSALMLTMEDLLQAAARLQPSVSEQELLRYKRIQRKFAAC

SEQ ID NO: 57446 - protein, 323 aa, Homo sapiens
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEVYSVDWSQTRGEQLVVSGSWDQTVKLWDPTVGKSLCTFRGHESIIYSTIWSPHIPGCFASASGDQTLRIWDVKAAGVRIVIPAHQAEILSCDWCKYNENLLVTGAVDCSLRGWDLRNVRQPVFELLGHTYAIRRVKFSPFHASVLASCSYDFTVRFWNFSKPDSLLETVEHHTEFTCGLDFSLQSPTQVADCSWDETIKIYDPACLTIPA

SEQ ID NO: 57447 - protein, 122 aa, Homo sapiens
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEYVQGSCVVK

SEQ ID NO: 57448 - protein, 280 aa, Homo sapiens
MSAVCGGAARMLRTPGRHGYAAEFSPYLPGRLACATAQHYGIAGCGTLLILDPDEAGLRLFRSFDWNDGLFDVTWSENNEHVLITCSGDGSLQLWDTAKAAGPLQVYKEHAQEVYSVDWSQTRGEQLVVSGSWDQTVKLWDPTVGKSLCTFRGHESIIYSTIWSPHIPGCFASASGDQTLRIWDVKAAGVRIVIPAHQAEILSCDWCKYNENLLVTGAVDCSLRGWDLRNVRQPVFELLGHTYAIRRVKMESCPVTQTRSQLTATSAFWVQAVLLPQPTE

SEQ ID NO: 57449 - protein, 303 aa, Homo sapiens
MASWAKGRSYLAPGLLQGQVAIVTGGATGIGKAIVKELLELGSNVVIASRKLERLKSAADELQANLPPTKQARVIPIQCNIRNEEEVNNLVKSTLDTFGKINFLVNNGGGQFLSPAEHISSKGWHAVLETNLTGTFYMCKAVYSSWMKEHGGSIVNIIVPTKAGFPLAVHSGAARAGVYNLTKSLALEWACSGIRINCVAPGVIYSQTAVENYGSWGQSFFEGSFQKIPAKRIGVPEEVSSVVCFLLSPAASFITGQSVDVDGGRSLYTHSYEVPDHDNWPKGAGDLSVVKKMKETFKEKAKL

SEQ ID NO: 57450 - protein, 468 aa, Homo sapiens
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAAIICCGDRPGLLNVGHIEKMQEGIVHVLRLHLQSNHPDDIFLFPKLLQKMADLRQLVTEHAQLVQIIKKTESDAALHPLLQEIYRDMY

SEQ ID NO: 57451 - protein, 468 aa, Homo sapiens; identical to SEQ ID NO: 57450

SEQ ID NO: 57452 - protein, 468 aa, Homo sapiens; identical to SEQ ID NO: 57450

SEQ ID NO: 57453 - protein, 468 aa, Homo sapiens; identical to SEQ ID NO: 57450

SEQ ID NO: 57454 - protein, 69 aa, Homo sapiens
MVDTESPLCPLSPLEAGDLESPLSEEFLQEMGNIQEISQSIGEDSSGSFGFTEYQYLGSCPGSDGSVIT

SEQ ID NO: 57455 - protein, 133 aa, Homo sapiens
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKVEGSWNRAWW

SEQ ID NO: 57456 - protein, 174 aa, Homo sapiens
MVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAFCHT

SEQ ID NO: 57457 - protein, 9 aa, Homo sapiens
MVDTESPLC

SEQ ID NO: 57458 - protein, 162 aa, Homo sapiens
MNKVKARVILSGKASNNPPFVIHDMETLCMAEKTLVAKLVANGIQNKEAEVRIFHCCQCTSVETVTELTEFAKAIPGFANLDLNDQVTLLKYGVYEAIFAMLSSVMNKDGMLVAYGNGFITREFLKSLRKPFCDIMEPKFDFAMKFNALELDDSDISLFVAA

SEQ ID NO: 57459 - protein, 441 aa, Homo sapiens
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 57460 - protein, 361 aa, Homo sapiens
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGGE

SEQ ID NO: 57461 - protein, 441 aa, Homo sapiens; identical to SEQ ID NO: 57459

SEQ ID NO: 57462 - protein, 343 aa, Homo sapiens
MEQPQEEAPEVREEEEKEEVAEAEGAPELNGGPQHALPSSSYTAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 57463 - protein, 361 aa, Homo sapiens; identical to SEQ ID NO: 57460

SEQ ID NO: 57464 - protein, 402 aa, Homo sapiens
MHQRDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 57465 - protein, 338 aa, Homo sapiens [sequence omitted]

SEQ ID NO: 57466 - protein, 505 aa, Homo sapiens
MGETLGDSPIDPESDSFTDTLSANISQEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 57467 - protein, 477 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 57468 - protein, 250 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSTAQVC

SEQ ID NO: 57469 - protein, 477 aa, Homo sapiens; identical to SEQ ID NO: 57467

SEQ ID NO: 57470 - protein, 477 aa, Homo sapiens; identical to SEQ ID NO: 57467

SEQ ID NO: 57471 - protein, 477 aa, Homo sapiens; identical to SEQ ID NO: 57467

SEQ ID NO: 57472 - protein, 483 aa, Homo sapiens
MKGFSEMTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSPFVIYDMNSLMMGEDKIKFKHITPLQEQSKEVAIRIFQGCQFRSVEAVQEITEYAKSIPGFVNLDLNDQVTLLKYGVHEIIYTMLASLMNKDGVLISEGQGFMTREFLKSLRKPFGDFMEPKFEFAVKFNALELDDSDLAIFIAVIILSGDRPGLLNVKPIEDIQDNLLQALELQLKLNHPESSQLFAKLLQKMTDLRQIVTEHVQLLQVIKKTETDMSLHPLLQEIYKDLY

SEQ ID NO: 57473 - protein, 132 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCK

SEQ ID NO: 57474 - protein, 99 aa, Homo sapiens
MTMVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPH

SEQ ID NO: 57475 - protein, 43 aa, Homo sapiens
MTMVDTEMPFWPTNFGISSVDLSVMEDHSHSFDIKPFTTVDFS

SEQ ID NO: 57476 - protein, 248 aa, Homo sapiens
MVDTEMPFWPTNFGISSVDLSVMEDHSHSFDIKPFTTVDFSSISTPHYEDIPFTRTDPVVADYKYDLKLQEYQSAIKVEPASPPYYSEKTQLYNKPHEEPSNSLMAIECRVCGDKASGFHYGVHACEGCKGFFRRTIRLKLIYDRCDLNCRIHKKSRNKCQYCRFQKCLAVGMSHNAIRFGRMPQAEKEKLLAEISSDIDQLNPESADLRALAKHLYDSYIKSFPLTKAKARAILTGKTTDKSTAQVC

SEQ ID NO: 57477 - protein, 984 aa, Homo sapiens
MAGNDCGALLDEELSSFFLNYLADTQGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 57478 - protein, 959 aa, Homo sapiens
MGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 57479 - protein, 798 aa, Homo sapiens
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKPTTLSLPLTPESPNDPKGSPFENKTIERTLSVELSGTAGLTPPTTPPHKANQDNPFRASPKLKSSCKTVVPPPSKKPRYSESSGTQGNNSTKKGPEQSELYAQLSKSSVLTGGHEERKTKRPSLRLFGDHDYCQSINSKTEILINISQELQDSRQLENKDVSSDWQGQICSSTDSDQCYLRETLEASKQVSPCSTRKQLQDQEIRAELNKHFGHPSQAVFDDEADKTGELRDSDFSNEQFSKLPMFINSGLAMDGLFDDSEDESDKLSYPWDGTQSYSLFNVSPSCSSFNSPCRDSVSPPKSLFSQRPQRMRSRSRSFSRHRSCSRSPYSRSRSRSPGSRSSSRSCYYYESSHYRHRTHRNSPLYVRSRSRSPYSRRPRYDSYEEYQHERLKREEYRREYEKRESERAKQRERQRQKAIEERRVIYVGKIRPDTTRTELRDRFEVFGEIEECTVNLRDDGDSYGFITYRYTCDAFAALENGYTLRRSNETDFELYFCGRKQFFKSNYADLDSNSDDFDPASTKSKYDSLDFDSLLKEAQRSLRR

SEQ ID NO: 57480 - protein, 1023 aa, Homo sapiens
MAGNDCGALLDEELSSFFLNYLADTQGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLLQKLLLATSYPTSSSDTQKEGTAWRQAGLRSKSQRPCVKADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYDSNSEEALPASGKSKYEAMDFDSLLKEAQQSLH

SEQ ID NO: 57481 - protein, 1017 aa, Homo sapiens
MAGNDCGALLDEELSSFFLNYLADTQGGGSGEEQLYADFPELDLSQLDASDFDSATCFGELQWCPENSETEPNQYSPDDSELFQIDSENEALLAELTKTLDDIPEDDVGLAAFPALDGGDALSCTSASPAPSSAPPSPAPEKPSAPAPEVDELSLLQKLLLATSYPTSSSDTQKEGTAWRQAGLRSKSQRPCVKADSTQDKKAPMMQSQSRSCTELHKHLTSAQCCLQDRGLQPPCLQSPRLPAKEDKEPGEDCPSPQPAPASPRDSLALGRADPGAPVSQEDMQAMVQLIRYMHTYCLPQRKLPPQTPEPLPKACSNPSQQVRSRPWSRHHSKASWAEFSILRELLAQDVLCDVSKPYRLATPVYASLTPRSRPRPPKDSQASPGRPSSVEEVRIAASPKSTGPRPSLRPLRLEVKREVRRPARLQQQEEEDEEEEEEEEEEEKEEEEEWGRKRPGRGLPWTKLGRKLESSVCPVRRSRRLNPELGPWLTFADEPLVPSEPQGALPSLCLAPKAYDVERELGSPTDEDSGQDQQLLRGPQIPALESPCESGCGDMDEDPSCPQLPPRDSPRCLMLALSQSDPTFGKKSFEQTLTVELCGTAGLTPPTTPPYKPTEEDPFKPDIKHSLGKEIALSLPSPEGLSLKATPGAAHKLPKKHPERSELLSHLRHATAQPASQAGQKRPFSCSFGDHDYCQVLRPEGVLQRKVLRSWEPSGVHLEDWPQQGAPWAEAQAPGREEDRSCDAGAPPKDSTLLRDHEIRASLTKHFGLLETALEEEDLASCKSPEYDTVFEDSSSSSGESSFLPEEEEEEGEEEEEDDEEEDSGVSPTCSDHCPYQSPPSKANRQLCSRSRSSSGSSPCHSWSPATRRNFRCESRGPCSDRTPSIRHARKRREKAIGEGRVVYIQNLSSDMSSRELKRRFEVFGEIEECEVLTRNRRGEKYGFITYRCSEHAALSLTKGAALRKRNEPSFQLSYGGLRHFCWPRYTDYGKPLKPSHSLVRLKAWEAVPSLNKTQS

SEQ ID NO: 57482 - protein, 156 aa, Homo sapiens
MAVGKFLLGSLLLLSLQLGQGWGPDARGVPVADGEFSSEQVAKAGGTWLGTHRPLARLRRALSGPCQLWSLTLSVAELGLGYASEEKVIFRYCAGSCPRGARTQHGLALARLQGQGRAHGGPCCRPTRYTDVAFLDDRHRWQRLPQLSAAACGCGG

SEQ ID NO: 57483 - protein, 473 aa, Homo sapiens
MGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQGAQARRGPRGASRDGGRGRGRGRPGKRVA

SEQ ID NO: 57484 - protein, 460 aa, Homo sapiens
MGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGRGRLCDQKFPKTKDKSQDGGRGRGRGRPGKRVA

SEQ ID NO: 57485 - protein, 794 aa, Homo sapiens
MGQSGRSRHQKRARAQAQLRNLEAYAANPHSFVFTRGCTGRNIRQLSLDVRRVMEPLTASRLQVRKKNSLKDCVAVAGPLGVTHFLILSKTETNVYFKLMRLPGGPTLTFQVKKYSLVRDVVSSLRRHRMHEQQFAHPPLLVLNSFGPHGMHVKLMATMFQNLFPSINVHKVNLNTIKRCLLIDYNPDSQELDFRHYSIKVVPVGASRGMKKLLQEKFPNMSRLQDISELLATGAGLSESEAEPDGDHNITELPQAVAGRGNMRAQQSAVRLTEIGPRMTLQLIKVQEGVGEGKVMFHSFVSKTEEELQAILEAKEKKLRLKAQRQAQQAQNVQRKQEQREAHRKKSLEGMKKARVGGSDEEASGIPSRTASLELGEDDDEQEDDDIEYFCQAVGEAPSEDLFPEAKQKRLAKSPGRKRKRWEMDRGAKSCPANFLAAADDKLSGFQGDFLWPILVVEFLVAVASNGLALYRFSIRKQRPWHPAVVFSVQLAVSDLLCALTLPPLAAYLYPPKHWRYGEAACRLERFLFTCNLLGSVIFITCISLNRYLGIVHPFFARSHLRPKHAWAVSAAGWVLAALLAMPTLSFSHLKRPQQGAGNCSVARPEACIKCLGTADHGLAAYRAYSLVLAGLGCGLPLLLTLAAYGALGRAVLRSPGMTVAEKLRVAALVASGVALYASSYVPYHIMRVLNVDARRRWSTRCPSFADIAQATAALELGPYVGYQVMRGLMPLAFCVHPLLYMAAVPSLGCCCRHCPGYRDSWNPEDAKSTGQALPLNATAAPKPSEPQSRELSQ

SEQ ID NO: 57486 - protein, 457 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSRLLSALNSHKDRFISGREIKKRKCLFGLHARMPPPVEPPTGDGALTRAGPWGRGLTSPGEAPEAGARAPEEEAEGESGGAGATLSSAQSARAPGAEGAGSSAEGTAAAPSGCLLPSTLLPAPQGPLGTVDPQTGHPWNFTLVSPQTSLKVPPTR

SEQ ID NO: 57487 - protein, 567 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSRLLSALNSHKDRFISGREIKKRKCLFGLHARMPPPVEPPTGDGALTSFPSGQGPGGGVSRPLGKRRRPEPEPLRRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 57488 - protein, 243 aa, Homo sapiens
  MOD_RES (1)..(1): Any amino acid
XSLLLTATRTVSFQGERLRRGNVCLVSMLGCLPLWSPLLEMEHSPGQGPGGGVSRPLGKRRRPEPEPLRRRQKGKVEELGPPSAVRNQPEPQEQRERAHLQRALQASVSPPSPSPNQSYQGSSGYNFRPTDARCLPSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPD

SEQ ID NO: 57489 - protein, 145 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIAT

SEQ ID NO: 57490 - protein, 181 aa, Homo sapiens
WGHPQQCAISPSPRSRGSGLICRGHCRPQCLHHPPALTRVTRAAAATTSGPQMPAACPGHPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 57491 - protein, 145 aa, Homo sapiens; identical to SEQ ID NO: 57489

SEQ ID NO: 57492 - protein, 567 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTSFPSGQGPGGGVSRPLGKRRRPEPEPLRRRQKGKVEELGPPSAVRNQPEPQEQRERAHLQRALQASVSPPSPSPNQSYQGSSGYNFRPTDARCLPSSPIRMFASFHPSASTAGTSGDSGPPDRSPLELHIGFPTDIPKSAPHSMTASSSSVSSPSPGLPRRSAPPSPLCRSLSPGTGGGVRGGVGYLSRGDPVRVLARRVRPDGSVQYLVEWGGGGIF

SEQ ID NO: 57493 - protein, 227 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGD

SEQ ID NO: 57494 - protein, 227 aa, Homo sapiens; identical to SEQ ID NO: 57493

SEQ ID NO: 57495 - protein, 457 aa, Homo sapiens
MAQPPRLSRSGASSLWDPASPAPTSGPRPRLWEGQDVLARWTDGLLYLGTIKKVDSAREVCLVQFEDDSQFLVLWKDISPAALPGEELLCCVCRSETVVPGNRLVSCEKCRHAYHQDCHVPRAPAPGEGEGTSWVCRQCVFAIATKRGGALKKGPYARAMLGMKLSLPYGLKGLDWDAGHLSNRQQSYCYCGGPGEWNLKMLQCRSCLQWFHEACTQCLSKPLLYGDRFYEFECCVCRGGPEKVRRLQLRWVDVAHLVLYHLSVCCKKKYFDFDREILPFTSENWDSLLLGELSDTPKGERSSKLLSALNSHKDRFISGREIKKRKCLFGLHARMPPPVEPPTGDGALTRAGPWGRGLTSPGEAPEAGARAPEEEAEGESGGAGATLSSAQSARAPGAEGAGSSAEGTAAAPSGCLLPSTLLPAPQGPLGTVDPQTGHPWNFTLVSPQTSLKVPPTR

SEQ ID NO: 57496 - protein, 498 aa, Homo sapiens
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPDLERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 57497 - protein, 496 aa, Homo sapiens
MAAAAGPGAALSPRPCDSDPATPGAQSPKDDNEDNSNDGTQPSKRRRMGSGDSSRSCETSSQDLGFSYYPAENLIEYKWPPDETGEYYMLQEQVSEYLGVTSFKRKYPERRDLSHKEKLYLRELNVITETQCTLGLTALRSDEVIDLMIKEYPAKHAEYSVILQEKERQRITDHYKEYSQMQQQNTQKVEASKVPEYIKKAAKKAAEFNSNLNRERMEERRAYFDLQTHVIQVPQGKYKVLPTERTKVSSYPVALIPGQFQEYYKRYSPDELRYLPLNTALYEPPLDPELPALDSDGDSDDGEDGRGDEKRKNKGTSDSSSGNVSEGESPPDSQEDSFQGRQKSKDKAATPRKDGPKRSVLSKSVPGYKPKVIPNAICGICLKGKESNKKGKAESLIHCSQCENSGHPSCLDMTMELVSMIKTYPWQCMECKTCIICGQPHHEEEMMFCDMCDRGYHTFCVGLGAIPSGRWICDCCQRAPPTPRKVGRRGKNSKEG

SEQ ID NO: 57498 - protein, 292 aa, Homo sapiens
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQRWQQLKEEIELLQDLKQTLCSFQENRDLMSSSTSISSLSY

SEQ ID NO: 57499 - protein, 331 aa, Homo sapiens
MAQASPPRPERVLGASSPEARPAQEALLLPTGVFQVAEKMEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQRWQQLKEEIELLQDLKQTLCSFQENRDLMSSSTSISSLSY

SEQ ID NO: 57500 - protein, 286 aa, Homo sapiens
  MOD_RES (1)..(1): Any amino acid
XRPGPRGCSAPAARRPGPRRRRSSFPPLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEEHGRHTDATVKVPFLKKCKEAGLLNYLLEEILDKVHSIPEKLMDETTSESDYEEIGSALFDCRLFEDTFVNFQAAIEKKIHASQQRWQQLKEEIELLQDLKQTLCSFQENRDLMSSSTSISSLSY

SEQ ID NO: 57501 - protein, 168 aa, Homo sapiens
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAKKDDAVPQSDGVRGIYKLLCQQHAQFPIIAQSAKFSGVKRKRGRKKPLSGNHVQPPETMKCNTFIRQVKEE

SEQ ID NO: 57502 - protein, 98 aa, Homo sapiens
MEKRTCALCPKDVEYNVLYFAQSENIAAHENCLLYSSGLVECEDQDPLNPDRSFDVESVKKEIQRGRKLKCKFCHKRGATVGCDLKNCNKNYHFFCAK

SEQ ID NO: 57503 - protein, 292 aa, Homo sapiens; identical to SEQ ID NO: 57498

SEQ ID NO: 57504 - protein, 207 aa, Homo sapiens
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRVSLPSSPVPASPASSSGADQRLPSQSLSSKQKGHTWALETDSASATVLGQDL

SEQ ID NO: 57505 - protein, 580 aa, Homo sapiens
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAIARTLQAVKMVLSYQPEELEWDSPHRTNQQQCYCYCGGPGEWYLRMLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLACGEKYQVLARRVTPEGKVQYLVEWEGTTPY

SEQ ID NO: 57506 - protein, 371 aa, Homo sapiens
MLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLACGEKYQVLARRVTPEGKVQYLVEWEGTTPY

SEQ ID NO: 57507 - protein, 166 aa, Homo sapiens
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAIA

SEQ ID NO: 57508 - protein, 107 aa, Homo sapiens
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTS

SEQ ID NO: 57509 - protein, 563 aa, Homo sapiens
MENRALDPGTRDSYGATSHLPNKGALAKVKNNFKDLMSKLTEGQYVLCRWTDGLYYLGKIKRVSSSKQSCLVTFEDNSKYWVLWKDIQHAGVPGEEPKCNICLGKTSGPLNEILICGKCGLGYHQQCHIPIAGSADQPLLTPWFCRRCIFALAVRKGGALKKGAIARTLQAVKMVLSYQPEELEWDSPHRTNQQQCYCYCGGPGEWYLRMLQCYRCRQWFHEACTQCLNEPMMFGDRFYLFFCSVCNQGPEYIERLPLRWVDVVHLALYNLGVQSKKKYFDFEEILAFVNHHWELLQLGKLTSTPVTDRGPHLLNALNSYKSRFLCGKEIKKKKCIFRLRIRVPPNPPGKLLPDKGLLPNENSASSELRKRGKSKPGLLPHEFQQQKRRVYRRKRSKFLLEDAIPSSDFTSAWSTNHHLASIFDFTLDEIQSLKSASSGQTFFSDVDSTDAASTSGSASTSLSYDSRWTVGSRKRKLAAKAYMPLRAKRWAAELDGRCPSDSSAEGASVPERPDEGIDSHTFESISEDDSSLSHLKSSITNYFGAAGRLAWGEVPGVGSEGHT

SEQ ID NO: 57510 - protein, 1096 aa, Homo sapiens
MATVPVYCVCRLPYDVTRFMIECDACKDWFHGSCVGVEEEEAPDIDIYHCPNCEKTHGKSTLKKKRTWHKHGPGQAPDVKPVQNGSQLFIKELRSRTFPSAEDVVARVPGSQLTLGYMEEHGFTEPILVPKKDGLGLAVPAPTFYVSDVENYVGPERSVDVTDVTKQKDCKMKLKEFVDYYYSTNRKRVLNVTNLEFSDTRMSSFVEPPDIVKKLSWVENYWPDDALLAKPKVTKYCLICVKDSYTDFHIDSGGASAWYHVLKGEKTFYLIRPASANISLYERWRSASNHSEMFFADQVDKCYKCIVKQGQTLFIPSGWIYATLTPVDCLAFAGHFLHSLSVEMQMRAYEVERRLKLGSLTQFPNFETACWYMGKHLLEAFKGSHKSGKQLPPHLVQGAKILNGAFRSWTKKQALAEHEDELPEHFKPSQLIKDLAKEIRLSENASKAVRPEVNTVASSDEVCDGDREKEEPPSPIEATPPQSLLEKVSKKKTPKTVKMPKPSKIPKPPKPPKPPRPPKTLKLKDGGKKKGKKSRESASPTIPNLDLLEAHTKEALTKMEPPKKGKATKSVLSVPNKDVVHMQNDVERLEIREQTKSKSEAKWKYKNSKPDSLLKMEEEQKLEKSPLAGNKDNKFSFSFSNKKLLGSKALRPPTSPGVFGALQNFKEDKPKPVRDEYEYVSDDGELKIDEFPIRRKKNAPKRDLSFLLDKKAVLPTPVTKPKLDSAAYKSDDSSDEGSLHIDTDTKPGRNARVKKESGSSAAGILDLLQASEEVGALEYNPSSQPPASPSTQEAIQGMLSMANLQASDSCLQTTWGAGQAKGSSLAAHGARKNGGGSGKSAGKRLLKRAAKNSVDLDDYEEEQDHLDACFKDSDYVYPSLESDEDNPIFKSRSKKRKGSDDAPYSPTARVGPSVPRQDRPVREGTRVASIETGLAAAAAKLSQQEEQKSKKKKSAKRKLTPNTTSPSTSTSISAGTTSTSTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 57511 - protein, 327 aa, Homo sapiens
MATVPVYCVCRLPYDVTRFMIECDACKDWFHGSCVGVEEEEAPDIDIYHCPNCEKTHGKSTLKKKRTWHKHGPGQAPDVKPKNSVDLDDYEEEQDHLDACFKDSDYVYPSLESDEDNPIFKSRSKKRKGSDDAPYSPTARVGPSVPRQDRPVREGTRVASIETGLAAAAAKLSQQEEQKSKKKKSAKRKLTPNTTSPSTSTSISAGTTSTSTTPASTTPASTTPASTSTASSQASQEGSSPEPPPESHSSSLADHEYTAAGTFTGAQAGRTSQPMAPGVFLTQRRPSASSPNNNTAAKGKRTKKGMATAKQRLGKILKIHRNGKLLL

SEQ ID NO: 57512 - protein, 681 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRGRPPKYNAVLGFGALTPTSPQSSHPDSPENEKTETTFTFPAPVQPVSLPSPTSTDGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 57513 - protein, 634 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLQVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRANEEHWPKGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 57514 - protein, 680 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLVQATPPQPIKVPQFIPPPRLTPRPNFLPQVRPKPVAQNNIPIAPAPPPMLAAPQLIQRPVMLTKFTPTTLPTSQNSIHPVRVVNGQTATIAKTFPMAQLTSIVIATPGTRLAGPQTVQLSKPSLEKQTVKSHTETDEKQTESRTITPPAAPKPKREENPQKLAFMVSLGLVTHDHLEEIQSKRQERKRRTTANPVYSGAVFEPERKKSAVTYLNSTMHPGTRKRGRPPKYNAVLGFGALTPTSPQSSHPDSPENEKTETTFTFPAPVQPVSLPSPTSTDGDIHEDFCSVCRKSGQLLMCDTCSRVYHLDCLDPPLKTIPKGMWICPRCQDQMLKKEEAIPWPGTLAIVHSYIAYKAAKEEEKQKLLKWSSDLKQEREQLEQKVKQLSNSISKCMEMKNTILARQKEMHSSLEKVKQLIRLIHGIDLSKPVDSEATVGAISNGPDCTPPANAATSTPAPSPSSQSCTANCNQGEETK

SEQ ID NO: 57515 - protein, 26 aa, Homo sapiens
MELQTLQEALKVEIQVHQKLVAQMKQ

SEQ ID NO: 57516 - protein, 11 aa, Homo sapiens
MELQTLQEALK

SEQ ID NO: 57517 - protein, 101 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQY

SEQ ID NO: 57518 - protein, 9 aa, Homo sapiens
MELQTLQEA

SEQ ID NO: 57519 - protein, 51 aa, Homo sapiens
MELQTLQEALKVEIQVHQKLVAQMKQDPQNADLKKQLHELQAKITALSEKQ

SEQ ID NO: 57520 - protein, 158 aa, Homo sapiens
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPPCAANTP

SEQ ID NO: 57521 - protein, 403 aa, Homo sapiens
MLEAMAEPSPEDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 57522 - protein, 399 aa, Homo sapiens
MPGDCRRDPPPTLKPETQPPEKRRRTIEDFNKFCSFVLAYAGYIPPSKEESDWPASGSSSPLRGESAADSDGWDSAPSDLRTIQTFVKKAKSSKRRAAQAGPTQPGPPRSTFSRLQAPDSATLLEKMKLKDSLFDLDGPKVASPLSPTSLTHTSRPPAALTPVPLSQGDLSHPPRKKDRKNRKLGPGAGAGFGVLRRPRPTPGDGEKRSRIKKSKKRKLKKAERGDRLPPPGPPQAPPSDTDSEEEEEEEEEEEEEEMATVVGGEAPVPVLPTPPEAPRPPATVHPEGVPPADSESKEVGSTETSQDGDASSSEGEMRVMDEDIMVESGDDSWDLITCYCRKPFAGRPMIECSLCGTWIHLSCAKIKKTNVPDFFYCQKCKELRPEARRLGGPPKSGEP

SEQ ID NO: 57523 - protein, 2039 aa, Homo sapiens
MDIVDTFNHLIPTEHLDDALFLGSNLENEVCEDFSASQNVLEDSLKNMLSDKDPMLGSASNQFCLPVLDSNDPNFQMPCSTVVGLDDIMDEGVVKESGNDTIDEEELILPNRNLRDKVEENSVRSPRKSPRLMAQEQVRSLRQSTIAKRSNAAPLSNTKKASGKTVSTAKAGVKQPERSQVKEEVCMSLKPEYHKENRRCSRNSGQIEVVPEVSVSSSHSSVSSCLEMKDEDGLDSKHKCNNPGEIDVPSHELNCSLLSETCVTIGEKKNEALMECKAKPVGSPLFKFSDKEEHEQNDSISGKTGETVVEEMIATRKVEQDSKETVKLSHEDDHILEDAGSSDISSDAACTNPNKTENSLVGLPSCVDEVTECNLELKDTMGIADKTENTLERNKIEPLGYCEDAESNRQLESTEFNKSNLEVVDTSTFGPESNILENAICDVPDQNSKQLNAIESTKIESHETANLQDDRNSQSSSVSYLESKSVKSKHTKPVIHSKQNMTTDAPKKIVAAKYEVIHSKTKVNVKSVKRNTDVPESQQNFHRPVKVRKKQIDKEPKIQSCNSGVKSVKNQAHSVLKKTLQDQTLVQIFKPLTHSLSDKSHAHPGCLKEPHHPAQTGHVSHSSQKQCHKPQQQAPAMKTNSHVKEELEHPGVEHFKEEDKLKLKKPEKNLQPRQRRSSKSFSLDEPPLFIPDNIATIRREGSDHSSSFESKYMWTPSKQCGFCKKPHGNRFMVGCGRCDDWFHGDCVGLSLSQAQQMGEEDKEYVCVKCCAEEDKKTEILDPDTLENQATVEFHSGDKTMECEKLGLSKHTTNDRTKYIDDTVKHKVKILKRESGEGRNSSDCRDNEIKKWQLAPLRKMGQPVLPRRSSEEKSEKIPKESTTVTCTGEKASKPGTHEKQEMKKKKVEKGVLNVHPAASASKPSADQIRQSVRHSLKDILMKRLTDSNLKVPEEKAAKVATKIEKELFSFFRDTDAKYKNKYRSLMFNLKDPKNNILFKKVLKGEVTPDHLIRMSPEELASKELAAWRRRENRHTIEMIEKEQREVERRPITKITHKGEIEIESDAPMKEQEAAMEIQEPAANKSLEKPEGSEKQKEEVDSMSKDTTSQHRQHLFDLNCKICIGRMAPPVDDLSPKKVKVVVGVARKHSDNEAESIADALSSTSNILASEFFEEEKQESPKSTFSPAPRPEMPGTVEVESTFLARLNFIWKGFINMPSVAKFVTKAYPVSGSPEYLTEDLPDSIQVGGRISPQTVWDYVEKIKASGTKEICVVRFTPVTEEDQISYTLLFAYFSSRKRYGVAANNMKQVKDMYLIPLGATDKIPHPLVPFDGPGLELHRPNLLLGLIIRQKLKRQHSACASTSHIAETPESAPPIALPPDKKSKIEVSTEEAPEEENDFFNSFTTVLHKQRNKPQQNLQEDLPTAVEPLMEVTKQEPPKPLRFLPGVLIGWENQPTTLELANKPLPVDDILQSLLGTTGQVYDQAQSVMEQNTVKEIPFLNEQTNSKIEKTDNVEVTDGENKEIKVKVDNISESTDKSAEIETSVVGSSSISAGSLTSLSLRGKPPDVSTEAFLTNLSIQSKQEETVESKEKTLKRQLQEDQENNLQDNQTSNSSPCRSNVGKGNIDGNVSCSENLVANTARSPQFINLKRDPRQAAGRSQPVTTSESKDGDSCRNGEKHMLPGLSHNKEHLTEQINVEEKLCSAEKNSCVQQSDNLKVAQNSPSVENIQTSQAEQAKPLQEDILMQNIETVHPFRRGSAVATSHFEVGNTCPSEFPSKSITFTSRSTSPRTSTNFSPMRPQQPNLQHLKSSPPGFPFPGPPNFPPQSMFGFPPHLPPPLLPPPGFGFAQNPMVPWPPVVHLPGQPQRMMGPLSQASRYIGPQNFYQVKDIRRPERRHSDPWGRQDQQQLDRPFNRGKGDRQRFYSDSHHLKRERHEKEWEQESERHRRRDRSQDKDRDRKSREEGHKDKERARLSHGDRGTDGKASRDSRNVDKKPDKPKSEDYEKDKEREKSKHREGEKDRDRYHKDRDHTDRTKSKR

SEQ ID NO: 57524 - protein, 2039 aa, Homo sapiens; identical to SEQ ID NO: 57523

SEQ ID NO: 57525 - protein, 365 aa, Homo sapiens
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMKCTLCSQPGATIGCEIKACVKTYHYHCGVQDKAKYIENMSRGIYKLYCKNHSGNDERDEEDEERESKSRGKVEIDQQQLTQQQLNGN

SEQ ID NO: 57526 - protein, 324 aa, Homo sapiens
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEAADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMKCTLCSQPGATIGCEIKACVKTYHYHCGVQDKAKYIENMSRGIYK

SEQ ID NO: 57527 - protein, 312 aa, Homo sapiens
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEAADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMVCSFYICYATLHLICCFKFRVHPKFIQSSENLK

SEQ ID NO: 57528 - protein, 365 aa, Homo sapiens; identical to SEQ ID NO: 57525

SEQ ID NO: 57529 - protein, 366 aa, Homo sapiens
MSSSVEQKKGPTRQRKCGFCKSNRDKECGQLLISENQKVAAHHKCMLFSSALVSSHSDNESLGGFSIEDVQKEIKRGTKLMCSLCHCPGATIGCDVKTCHRTYHYHCALHDKAQIREKPSQGIYMVYCRKHKKTAHNSEAADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMKCTLCSQPGATIGCEIKACVKTYHYHCGVQDKAKYIENMSRGIYKLYCKNHSGNDERDEEDEERESKSRGKVEIDQQQLTQQQLNGN

SEQ ID NO: 57530 - protein, 331 aa, Homo sapiens
MSSSVEQKKGPTRQRKCGFCKSNRDKECGQLLISENQKVAAHHKCMMCSLCHCPGATIGCDVKTCHRTYHYHCALHDKAQIREKPSQGIYMVYCRKHKKTAHNSEADLEESFNEHELEPSSPKSKKKSRKGRPRKTNFKGLSEDTRSTSSHGTDEMESSSYRDRSPHRSSPSDTRPKCGFCHVGEEENEARGKLHIFNAKKAAAHYKCMLFSSGTVQLTTTSRAEFGDFDIKTVLQEIKRGKRMKCTLCSQPGATIGCEIKACVKTYHYHCGVQDKAKYIENMSRGIYKLYCKNHSGNDERDEEDEERESKSRGKVEIDQQQLTQQQLNGN

SEQ ID NO: 57531 - protein, 1024 aa, Homo sapiens
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 57532 - protein, 948 aa, Homo sapiens
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLLRQVIVQAECRQAIHEPKLKRRDAHP

SEQ ID NO: 57533 - protein, 1060 aa, Homo sapiens
MNRSRAIVQRGRVLPPPAPLDTTNLAGRRTLQGRAKMASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 57534 - protein, 303 aa, Homo sapiens
MDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRASLALTPTEFVNQEKLSLTLRRTIQQMRTWWKGLKASLGMVVALVAFLICSRPAGRWGDLTMLPSPRPQLLPALRRPSRACCAWPTCSPHRPHRLPLACRPGGLGDRIEAVGAPAVGWAQCLTVLLPSAPQGSGPSSGQHTGEPRARRRRRTPVWMNRTAWERASRMQSISILHWSLMMMTLL

SEQ ID NO: 57535 - protein, 953 aa, Homo sapiens
IVQRGRVLPPPAPLDTTNLAGRRTLQGRAKMASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGKLGNGSGAGGILDLLKASRQVGGPDYAALTEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQELQKAQKKKYIKKKPLLKEVEQPRPQDSNLSLTVPAPTVAATPQLVTSSSPLPPPEPKQEALSGSLADHEYTARPNAFGMAQANRSTTPMAPGVFLTQRRPSVGSQSNQAGQGKRPKKGLATAKQRLGRILKIHRNGKLLL

SEQ ID NO: 57536 - protein, 114 aa, Homo sapiens
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVE

SEQ ID NO: 57537 - protein, 126 aa, Homo sapiens
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPIL

SEQ ID NO: 57538 - protein, 97 aa, Homo sapiens
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFD

SEQ ID NO: 57539 - protein, 115 aa, Homo sapiens
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEF

SEQ ID NO: 57540 - protein, 97 aa, Homo sapiens; identical to SEQ ID NO: 57538

SEQ ID NO: 57541 - protein, 148 aa, Homo sapiens
MNRSRAIVQRGRVLPPPAPLDTTNLAGRRTLQGRAKMASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLT

SEQ ID NO: 57542 - protein, 878 aa, Homo sapiens
MASVPVYCLCRLPYDVTRFMIECDMCQDWFHGSCVGVEEEKAADIDLYHCPNCEVLHGPSIMKKRRGSSKGHDTHKGKPVKTGSPTFVRELRSRTFDSSDEVILKPTGNQLTVEFLEENSFSVPILVLKKDGLGMTLPSPSFTVRDVEHYVGSDKEIDVIDVTRQADCKMKLGDFVKYYYSGKREKVLNVISLEFSDTRLSNLVETPKIVRKLSWVENLWPEECVFERPNVQKYCLMSVRDSYTDFHIDFGGTSVWYHVLKGEKIFYLIRPTNANLTLFECWSSSSNQNEMFFGDQVDKCYKCSVKQGQTLFIPTGWIHAVLTPVDCLAFGGNFLHSLNIEMQLKAYEIEKRLSTADLFRFPNFETICWYVGKHILDIFRGLRENRRHPASYLVHGGKALNLAFRAWTRKEALPDHEDEIPETVRTVQLIKDLAREIRLVEDIFQQNVGKTSNIFGLQRIFPAGSIPLTRPAHSTSVSMSRLSLPSKNGSKKKGLKPKELFKKAERKGKESSALGPAGQLSYNLMDTYSHQALKTGSFQKAKFNITGACLNDSDDDSPDLDLDGNESPLALLMSNGSTKRVKSLSKSRRTKIAKKVDKARLMAEQVMEDEFDLDSDDELQIDERLGKEKATLIIRPKFPRKLPRAKPCSDPNRVREPGEVEFDIEEDYTTDEDMVEGVEGYQTATPAPAQGASEAPASPSTQEAIQGMLCMANLQSSSSSPATSSLQAWWTGGQDRSSGSSSSGLGTVSNSPASQRTPGKRPIKRPAYWRTESEEEEENASLDEQDSLGACFKDAEYIYPSLESDDDDPALKSRPKKKKNSDDAPWSPKARVTPTLPKQDRPVREGTRVASIETGLAAAAAKLAQQVKKMKLSLTDSG

SEQ ID NO: 57543 - protein, 138 aa, Homo sapiens
MKLPIFIADAFTARAFRGNPAAVCLLENELDEDMHQKIAREMNLSETAFIRKLHPTDNFAQKNMNSTLTFVTLSGELRARRAEDGIVLDLPLYPAHPQDFHEVEDLIKTAIGNTLVQDICYSPDTQKLLVRLSDVYNR

SEQ ID NO: 57544 - protein, 288 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHAFQCSHRGGELGISLRPDGRVDIRGGAAVVLEGTLTA

SEQ ID NO: 57545 - protein, 255 aa, Homo sapiens
MHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHAFQCSHRGGELGISLRPDGRVDIRGGAAVVLEGTLTA

SEQ ID NO: 57546 - protein, 288 aa, Homo sapiens; identical to SEQ ID NO: 57544

SEQ ID NO: 57547 - protein, 280 aa, Homo sapiens
MKLPIFIADAFTARAFRGNPAAVCLLENELDEDMHQKIAREMNLSETAFIRKLHPTDNFAQSSCFGLRWFTPASEVPLCGHATLASAAVLFHKIKNMNSTLTFVTLSGELRARRAEDGIVLDLPLYPAHPQDFHEVEDLIKTAIGNTLVQDICYSPDTQKLLVRLSDVYNRSFLENLKVNTENLLQVENTGKVKGLILTLKGEPGGQTQAFDFYSRYFAPWVGVAEDPVTGSAHAVLSSYWSQHLGKKEMHGRTALYQFLFYLPNSKLVFLLICTIPLKM

SEQ ID NO: 57548 - protein, 451 aa, Homo sapiens
MVGSALRRGAHAYVYLVSKASHISRGHQHQAWGSRPPAAECATQRAPGSVVELLGKSYPQDDHSNLTRKVLTRVGRNLHNQQHHPLWLIKERVKEHFYKQYVGRFGTPLFSVYDNLSPVVTTWQNFDSLLIPADHPSRKKGDNYYLNRTHMLRAHTSAHQWDLLHAGLDAFLVVGDVYRRDQIDSQHYPIFHQLEAVRLFSKHELFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSAGAQDRIGWAFGLGLERLAMILYDIPDIRLFWCEDERFLKQFCVSNINQKVKFQPLSKYPAVINDISFWLPSENYAENDFYDLVRTIGGDLVEKVDLIDKFVHPKTHKTSHCYRITYRHMERTLSQREVRHIHQALQEAAVQLLGVEGRF

SEQ ID NO: 57549 - protein, 451 aa, Homo sapiens; identical to SEQ ID NO: 57548

SEQ ID NO: 57550 - protein, 155 aa, Homo sapiens
MLRAHTSAHQWDLLHAGLDAFLVVGDVYRRDQIDSQHYPIFHQLEAVRLFSKHELFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSGGAT

SEQ ID NO: 57551 - protein, 101 aa, Homo sapiens
LFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSGGAT

SEQ ID NO: 57552 - protein, 282 aa, Homo sapiens
MSGADRSPNAGAAPDSAPGQAAVASAYQRFEPRAYLRNNYAPPRGDLCNPNGVGPWKLRCLAQTFATGEVSGRTLIDIGSGPTVYQLLSACSHFEDITMTDFLEVNRQELGRWLQEEPGAFNWSMYSQHACLIEGKGECWQDKERQLRARVKRVLPIDVHQPQPLGAGSPAPLPADALVSAFCLEAVSPDLASFQRALDHITTLLRPGGHLLLIGALEESWYLAGEARLTVVPVSEEEVREALVRSGYKVRDLRTYIMPAHLQTGVDDVKGVFFAWAQKVGL

SEQ ID NO: 57553 - protein, 184 aa, Homo sapiens
MTDFLEVNRQELGRWLQEEPGAFNWSMYSQHACLIEGKGECWQDKERQLRARVKRVLPIDVHQPQPLGAGSPAPLPADALVSAFCLEAVSPDLASFQRALDHITTLLRPGGHLLLIGALEESWYLAGEARLTVVPVSEEEVREALVRSGYKVRDLRTYIMPAHLQTGVDDVKGVFFAWAQKVGL

SEQ ID NO: 57554 - protein, 246 aa, Homo sapiens
MEEAKSQSLEEDFEGQATHTGPKGVINDWRKFKLESQDSDSIPPSKKEILRQMSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 57555 - protein, 246 aa, Homo sapiens; identical to SEQ ID NO: 57554

SEQ ID NO: 57556 - protein, 194 aa, Homo sapiens
MSSPQSRNGKDSKERVSRKMSIQEYELIHKEKEDENCLRKYRRQCMQDMHQKLSFGPRYGFVYELETGKQFLETIEKELKITTIVVHIYEDGIKGCDALNSSLTCLAAEYPIVKFCKIKASNTGAGDRFSLDVLPTLLIYKGGELISNFISVAEQFAEEFFAGDVESFLNEYGLLPEREVHVLEHTKIEEEDVE

SEQ ID NO: 57557 - protein, 194 aa, Homo sapiens; identical to SEQ ID NO: 57556

SEQ ID NO: 57558 - protein, 301 aa, Homo sapiens
MTTLDDKLLGEKLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKMTLKEFAIMNEDQDDEEFLQQYRKQRMEEMRQQLHKGPQFKQVFEISSGEGFLDMIDKEQKSIVIMVHIYEDGIPGTEAMNGCMICLAAEYPAVKFCKVKSSVIGASSQFTRNALPALLIYKGGELIGNFVRVTDQLGDDFFAVDLEAFLQEFGLLPEKEVLVLTSVRNSATCHSEDSDLEID

SEQ ID NO: 57559 - protein, 109 aa, Homo sapiens
  MOD_RES (1)..(1): Any amino acid
XLQYYYSSSEDEDSDHEDKDRGRCAPASSSVPAEAELAGEGISVNTGPKGVINDWRRFKQLETEQREEQCREMERLIKKLSMTCRSHLDEEEEQQKQKDLQEKISGKER

SEQ ID NO: 57560 - protein, 91 aa, Homo sapiens
  MOD_RES (1)..(1): Any amino acid
XCAPASSSVPAEAELAGEGISVNTGPKGVINDWRRFKQLETEQREEQCREMERLIKKLSMTCRSHLDEEEEQQKQKDLQEKISGKKSWAIL

SEQ ID NO: 57561 - protein, 241 aa, Homo sapiens
MQDPNEDTEWNDILRDFGILPPKEESKDEIEEMVLRLQKEAMVKPFEKMTLAQLKEAEDEFDEEDMQAVETYRKKRLQEWKALKKKQKFGELREISGNQYVNEVTNAEEDVWVIIHLYRSSIPMCLLVNQHLSLLARKFPETKFVKAIVNSCIQHYHDNCLPTIFVYKNGQIEAKFIGIIECGGINLKLEELEWKLAEVGAIQTDLEENPRKDMVDMMVSSIRNTSIHDDSDSSNSDNDTK

SEQ ID NO: 57562 - protein, 239 aa, Homo sapiens
MQDPNADTEWNDILRKKGILPPKESLKELEEEAEEEQRILQQSVVKTYEDMTLEELEDHEDEFNEEDERAIEMYRRRRLAEWKATKLKNKFGEVLEISGKDYVQEVTKAGEGLWVILHLYKQGIPLCALINQHLSGLARKFPDVKFIKAISTTCIPNYPDRNLPTIFVYLEGDIKAQFIGPLVFGGMNLTRDELEWKLSESGAIMTDLEENPKKPIEDVLLSSVRRSVLMKRDSDSEGD

SEQ ID NO: 57563 - protein, 367 aa, Homo sapiens
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINEKKYHLQERVDKVKKKVKDVEEKSKEFVQKVEEKSIDLIQKWEEKSREFIGSFLEMFGPEGALKHMLKEGKGRMLQAISPKQSPSSSPTRERSPSPSFRWPFSGKTSPPCSPANLSRHKAAAYDISEDEED

SEQ ID NO: 57564 - protein, 293 aa, Homo sapiens
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINEKKYHLQERVDKVKKKVKDVEEKSKEFVQKVEEKSIDLIQKWEEKSREFIGSFLEMF

SEQ ID NO: 57565 - protein, 133 aa, Homo sapiens
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSDELTHNFKGFTVMNENERY

SEQ ID NO: 57566 - protein, 328 aa, Homo sapiens
MDAQCSAKVNARKRRKEAPGPNGATEEASRGTPCERPVRVYADGIFDLFHSGHARALMQAKNLFPNTYLIVGVCSDELTHNFKGFTVMNENERYDAVQHCRYVDEVVRNAPWTLTPEFLAEHRIDFVAHDDIPYSSAGSDDVYKHIKEAGMFAPTQRTEGISTSDIITRIVRDYDVYARRNLQRGYTAKELNVSFINEKKYHLQERVDKVKKKVKDVEEKSKEFVQKVEEKSIDLIQKWEEKSREFIGSFLEMFGPEGALKHMLKEGKGRMLQAISPKQSPSSSPTRERSPSPSFRWPFSGKTSPPCSPANLSRHKAAAYDISEDEED

SEQ ID NO: 57567 - protein, 367 aa, Homo sapiens; identical to SEQ ID NO: 57563

SEQ ID NO: 57568 - protein, 115 aa, Homo sapiens
MDAQCSAKVNARKRRKEAPGPNGATEEDGVPSKVQRCAVGLRQPAPFSDEIEVDFSKPYVRVTMEEASRGTPCERPVRVYADGIFDLFHSGHARALMQAKNLFPNTYLIVGVCSD

SEQ ID NO: 57569 - protein, 749 aa, Homo sapiens
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 57570 - protein, 452 aa, Homo sapiens
MIHLPRPPKVLGLQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 57571 - protein, 652 aa, Homo sapiens
MPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHVRCNSYRPEAAREQVQIGAHSPPQFRVNGAISNFEEFQKAFNCPPNSTMNRGMDSCRLW

SEQ ID NO: 57572 - protein, 695 aa, Homo sapiens
MEAETGSSVETGKKANRGTRIALVVFVGGTLVLGTILFLVSQGLLSLQAKQEYCLKPECIEAAAAILSKVNLSVDPCDNFFRFACDGWISNNPIPEDMPSYGVYPWLRHNVDLKLKELLEKSISRRRDTEAIQKAKILYSSCMNEKAIEKADAKPLLHILRHSPFRWPVLESNIGPEGVWSERKFSLLQTLATFRGQYSNSVFIRLYVSPDDKASNEHILKLDQATLSLAVREDYLDNSTEAKSYRDALYKFMVDTAVLLGANSSRAEHDMKSVLRLEIKIAEIMIPHENRTSEAMYNKMNISELSAMIPQFDWLGYIKKVIDTRLYPHLKDISPSENVVVRVPQYFKDLFRILGSERKKTIANYLVWRMVYSRIPNLSRRFQYRWLEFSRVIQGTTTLLPQWDKCVNFIESALPYVVGKMFVDVYFQEDKKEMMEELVEGVRWAFIDMLEKENEWMDAGTKRKAKEKARAVLAKVGYPEFIMNDTHVNEDLKAIKFSEADYFGNVLQTRKYLAQSDFFWLRKAVPKTEWFTNPTTVNAFYSASTNQIRFPAGELQKPFFWGTEYPRSLSYGAIGVIVGHEFTHGFDNNGRKYDKNGNLDPWWSTESEEKFKEKTKCMINQYSNYYWKKAGLNVKGKRTLGENIADNGGLREAFRAYRKWINDRRQGLEEPLLPGITFTNNQLFFLSYAHGQWCN

SEQ ID NO: 57573 - protein, 295 aa, Homo sapiens
MPSPRRSMEGRPLGVSASSSSSSPGSPAHGGGGGGSRFEFQSLLSSRATAVDPTCARLRASESPVHRRGSFPLAAAGPSQSPAPPLPEEDRMDLNPSFLGIALRSLLAIDLWLSKKLGVCAGESSSWGSVRPLMKLLEISGHGIPWLLGTLYCLCRSDSWAGREVLMNLLFALLLDLLLVALIKGLVRRRRPAHNQMDMFVTLSVDKYSFPSGHATRAALMSRFILNHLVLAIPLRVLVVLWAFVLGLSRVMLGRHNVTDVAFGFFLGYMQYSIVDYCWLSPHNAPVLFLLWSQR

SEQ ID NO: 57574 - protein, 204 aa, Homo sapiens [sequence omitted]

SEQ ID NO: 57575 - protein, 214 aa, Homo sapiens
MELAAGSFSEEQFWEACAELQQPALAGADWQLLVETSGISIYRLLDKKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 57576 - protein, 193 aa, Homo sapiens
LAQGRCLQVTAVQIQGSWKVTGVQPQKTGLYEYKVFGVLEDCSPTLLADIYMDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 57577 - protein, 142 aa, Homo sapiens
MDSDYRKQWDQYVKELYEQECNGETVVYWEVKYPFPMSNRDYVYLRQRRDLDMEGRKIHVILARSTSMPQLGERSGVIRVKQYKQSLAIESDGKKGSKVFMYYFDNPGGQIPSWLINWAAKNGVPNFLKDMARACQNYLKKT

SEQ ID NO: 57578 - protein, 187 aa, Homo sapiens
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDEPILSNRSGDHRGKFKVASFRKKYELRAPVAGTCYQAEWDDYVPKLYEQLSGK

SEQ ID NO: 57579 - protein, 155 aa, Homo sapiens
MPVDLSKWSGPLSLQEVDEQPQHPLHVTYAGAAVDELGKVLTPTQVKNRPTSISWDGLDSGKLYTLVLTDPDAPSRKDPKYREWHHFLVVNMKGNDISSGTVLSDYVGSGPPKGTGLHRYVWLVYEQDRPLKCDFSCCLAFIILLTHSDLCFDQI

SEQ ID NO: 57580 - protein, 2044 aa, Homo sapiens
MCPVDFHGIFQLDERRRDAVIALGIFLIESDLQHKDCVVPYLLRLLKGLPKVYWVEESTARKGRGALPVAESFSFCLVTLLSDVAYRDPSLRDEILEVLLQVLHVLLGMCQALEIQDKEYLCKYAIPCLIGISRAFGRYSNMEESLLSKLFPKIPPHSLRVLEELEGVRRRSFNDFRSILPSNLLTVCQEGTLKRKTSSVSSISQVSPERGMPPPSSPGGSAFHYFEASCLPDGTALEPEYYFSTISSSFSVSPLFNGVTYKEFNIPLEMLRELLNLVKKIVEEAVLKSLDAIVASVMEANPSADLYYTSFSDPLYLTMFKMLRDTLYYMKDLPTSFVKEIHDFVLEQFNTSQGELQKILHDADRIHNELSPLKLRCQANAACVDLMVWAVKDEQGAENLCIKLSEKLQSKTSSKVIIAHLPLLICCLQGLGRLCERFPVVVHSVTPSLRDFLVIPSPVLVKLYKYHSQYHTVAGNDIKISVTNEHSESTLNVMSGKKSQPSMYEQLRDIAIDNICRCLKAGLTVDPVIVEAFLASLSNRLYISQESDKDAHLIPDHTIRALGHIAVALRDTPKVMEPILQILQQKFCQPPSPLDVLIIDQLGCLVITGNQYIYQEVWNLFQQISVKASSVVYSATKDYKDHGYRHCSLAVINALANIAANIQDEHLVDELLMNLLELFVQLGLEGKRASERASEKGPALKASSSAGNLGVLIPVIAVLTRRLPPIKEAKPRLQKLFRDFWLYSVLMGFAVEGSGLWPEEWYEGVCEIATKSPLLTFPSKEPLRSVLQYNSAMKNDTVTPAELSELRSTIINLLDPPPEVSALINKLDFAMSTYLLSVYRLEYMRVLRSTDPDRFQVMFCYFEDKAIQKDKSGMMQCVIAVADKVFDAFLNMMADKAKTKENEEELERHAQFLLVNFNHIHKRIRRVADKYLSGLVDKFPHLLWSGTVLKTMLDILQTLSLSLSADIHKDQPYYDIPDAPYRITVPDTYEARESIVKDFAARCGMILQEAMKWAPTVTKSHLQEYLNKHQNWVSGLSQHTGLAMATESILHFAGYNKQNTTLGATQLSERPACVKKDYSNFMASLNLRNRYAGEVYGMIRFSGTTGQMSDLNKMMVQDLHSALDRSHPQHYTQAMFKLTAMLISSKDCDPQLLHHLCWGPLRMFNEHGMETALACWEWLLAGKDGVEVPFMREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 57581 - protein, 479 aa, Homo sapiens
MDETSPLVSPERAQPPDYTFPSGSGAHFPQVPGGAVRVAAAAGSGPSPPGSPGHDRERQPLLDRARGAAAQGQTQTVAAQAQALAAQAAAAAHAAQAHRERNEFPEDPEFEAVVRQAELAIERCIFPERIYQGSSGSYFVKDPQGRIIAVFKPKNEEPYGHLNPKWTKWLQKLCCPCCFGRDCLVLNQGYLSEAGASLVDQKLELNIVPRTKVVYLASETFNYSAIDRVKSRGKRLALEKVPKVGQRFNRIGLPPKVGSFQLFVEGYKDADYWLRRFEAEPLPENTNRQLLLQFERLVVLDYIIRNTDRGNDNWLIKYDCPMDSSSSRDTDWVVVKEPVIKVAAIDNGLAFPLKHPDSWRAYPFYWAWLPQAKVPFSQEIKDLILPKISDPNFVKDLEEDLYELFKKDPGFDRGQFHKQIAVMRGQILNLTQALKDNKSPLHLVQMPPVIVETARSHQRSSSESYTQSFQSRKPFFSWW

SEQ ID NO: 57582 - protein, 449 aa, Homo sapiens
MLGPQVWSSVRQGLSRSLSRNVGVWASGEGKKVDIAGIYPPVTTPFTATAEVDYGKLEENLHKLGTFPFRGAVGGVCALANVLGAQVCQLERLCCTGQWEDAQKLQHRLIEPNAARIIAVFKPKNEEPYGHLNPKWTKWLQKLCCPCCFGRDCLVLNQGYLSEAGASLVDQKLELNIVPRTKVVYLASETFNYSAIDRVKSRGKRLALEKVPKVGQRFNRIGLPPKVGSFQLFVEGYKDADYWLRRFEAEPLPENTNRQLLLQFERLVVLDYIIRNTDRGNDNWLIKYDCPMDSSSSRDTDWVVVKEPVIKVAAIDNGLAFPLKHPDSWRAYPFYWAWLPQAKVPFSQEIKDLILPKISDPNFVKDLEEDLYELFKKDPGFDRGQFHKQIAVMRGQILNLTQALKDNKSPLHLVQMPPVIVETARSHQRSSSESYTQSFQSRKPFFSWW

SEQ ID NO: 57583 - protein, 481 aa, Homo sapiens
MEDPSEPDRLASADGGSPEEEEDGEREPLLPRIAWAHPRRGAPGSAVRLLDAAGEEGEAGDEELPLPPGDVGVSRSSSAELDRSRPAVSVTIGTSEMNAFLDDPEFADIMLRAEQAIEVGIFPERISQGSSGSYFVKDPKRKIIGVFKPKSEEPYGQLNPKWTKYVHKVCCPCCFGRGCLIPNQGYLSEAGAYLVDNKLHLSIVPKTKVVWLVSETFNYNAIDRAKSRGKKYALEKVPKVGRKFHRIGLPPKIGSFQLFVEGYKEAEYWLRKFEADPLPENIRKQFQSQFERLVILDYIIRNTDRGNDNWLVRYEKQKCEKEIDHKESKWIDDEEFLIKIAAIDNGLAFPFKHPDEWRAYPFHWAWLPQAKVPFSEEIRNLILPYISDMNFVQDLCEDLYELFKTDKGFDKATFESQMSVMRGQILNLTQALRDGKSPFQLVQIPCVIVERSQGGSQGRIVHLSNSFTQTVNCRKPFFSSW

SEQ ID NO: 57584 - protein, 450 aa, Homo sapiens
MEDPSEPDRLASADGGSPEEEEDGEREPLLPRIAWAHPRRGAPGSAVRLLDRSRPAVSVTIGTSEMNAFLDDPEFADIMLRAEQAIEVGIFPERISQGSSGSYFVKDPKRKIIGVFKPKSEEPYGQLNPKWTKYVHKVCCPCCFGRGCLIPNQGYLSEAGAYLVDNKLHLSIVPKTKVVWLVSETFNYNAIDRAKSRGKKYALEKVPKVGRKFHRIGLPPKIGSFQLFVEGYKEAEYWLRKFEADPLPENIRKQFQSQFERLVILDYIIRNTDRGNDNWLVRYEKQKCEKEIDHKESKWIDDEEFLIKIAAIDNGLAFPFKHPDEWRAYPFHWAWLPQAKVPFSEEIRNLILPYISDMNFVQDLCEDLYELFKTDKGFDKATFESQMSVMRGQILNLTQALRDGKSPFQLVQIPCVIVERSQGGSQGRIVHLSNSFTQTVNCRKPFFSSW

SEQ ID NO: 57585 - protein, 2044 aa, Homo sapiens; identical to SEQ ID NO: 57580

SEQ ID NO: 57586 - protein, 854 aa, Homo sapiens
MREMAGAWHMTVEQKFGLFSAEIKEADPLAASEASQPKPCPPEVTPHYIWIDFLVQRFEIAKYCSSDQVEIFSSLLQRSMSLNIGGAKGSMNRHVAAIGPRFKLLTLGLSLLHADVVPNATIRNVLREKIYSTAFDYFSCPPKFPTQGEKRLREDISIMIKFWTAMFSDKKYLTASQLVPPDNQDTRSNLDITVGSRQQATQGWINTYPLSSGMSTISKKSGMSKKTNRGSQLHKYYMKRRTLLLSLLATEIERLITWYNPLSAPELELDQAGENSVANWRSKYISLSEKQWKDNVNLAWSISPYLAVQLPARFKNTEAIGNEVTRLVRLDPGAVSDVPEAIKFLVTWHTIDADAPELSHVLCWAPTDPPTGLSYFSSMYPPHPLTAQYGVKVLRSFPPDAILFYIPQIVQALRYDKMGYVREYILWAASKSQLLAHQFIWNMKTNIYLDEEGHQKDPDIGDLLDQLVEEITGSLSGPAKDFYQREFDFFNKITNVSAIIKPYPKGDERKKACLSALSEVKVQPGCYLPSNPEAIVLDIDYKSGTPMQSAAKAPYLAKFKVKRCGVSELEKEGLRCRSDSEDECSTQEADGQKISWQAAIFKVGDDCRQDMLALQIIDLFKNIFQLVGLDLFVFPYRVVATAPGCGVIECIPDCTSRDQLGRQTDFGMYDYFTRQYGDESTLAFQQARYNFIRSMAAYSLLLFLLQIKDRHNGNIMLDKKGHIIHIDFGFMFESSPGGNLGWEPDIKLTDEMVMIMGGKMEATPFKWFMEMCVRGYLAVRPYMDAVVSLVTLMLDTGLPCFRGQTIKLLKHRFSPNMTEREAANFIMKVIQSCFLSNRSRTYDMIQYYQNDIPY

SEQ ID NO: 57587 - protein, 87 aa, Homo sapiens
MCPVDFHGIFQLDERRRDAVIALGIFLIESDLQHKDCVVPYLLRLLKGLPKVYWVEESTARKGRGALPVAESFSFCLVTLLSDVAYR

SEQ ID NO: 57588 - protein, 652 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDPFSATVDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMAPPVMAYPATTPTGMIGYGIPPQMGSVPVMTQPTLIYSQPVMRPPNPFGPVSGAQIQFM

SEQ ID NO: 57589 - protein, 652 aa, Homo sapiens; identical to SEQ ID NO: 57588

SEQ ID NO: 57590 - protein, 645 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGDAVDDAIPSLNPFLTKSSGDVHLSISSDVSTFTTRTPTHEMFVGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMAPPVMAYPATTPTGMIGYGIPPQMGSVPVMTQPTLIYSQPVMRPPNPFGPVSGAQIQFM

SEQ ID NO: 57591 - protein, 610 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMNGMHFPQYAPPVMAYPATTPTGMIGYGIPPQMGSVPVMTQPTLIYSQPVMRPPNPFGPVSGAQIQFM

SEQ ID NO: 57592 - protein, 551 aa, Homo sapiens
MNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAEQVGIDRGDIPDLSQAPSSLLDALEQHLASLEGKKIKDSTAASRATTLSNAVSSLASTGLSLTKVDEREKQAALEEEQARLKALKEQRLKELAKKPHTSLTTAASPVSTSAGGIMTAPAIDIFSTPSSSNSTSKLPNDLLDLQQPTFHPSVHPMSTASQVASTWGGFTPSPVAQPHPSAGLNVDFESVFGNKSTNVIVDSGGFDELGGLLKPTVASQNQNLPVAKLPPSKLVSDDLDSSLANLVGNLGIGNGTTKNDVNWSQPGEKKLTGGSNWQPKVAPTTAWNAATMAPPVMAYPATTPTGMIGYGIPPQMGSVPVMTQPTLIYSQPVMRPPNPFGPVSGAQIQFM

SEQ ID NO: 57593 - protein, 484 aa, Homo sapiens
MACRGGAGNGHRASATLSRVSPGSLYTCRTRTHNICMVSDFFYPNMGGVESHIYQLSQCLIERGHKVIIVTHAYGNRKGIRYLTSGLKVYYLPLKVMYNQSTATTLFHSLPLLRYIFVRERVTIIHSHSSFSAMAHDALFHAKTMGLQTVFTDHSLFGFADVSSVLTNKLLTVSLCDTNHIICVSYTSKENTVLRAALNPEIVSVIPNAVDPTDFTPDPFRRHDSITIVVVSRLVYRKGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 57594 - protein, 169 aa, Homo sapiens
MAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 57595 - protein, 250 aa, Homo sapiens
MELTGIDLLSGIIPELCQKYPDLNFIIGGEGPKRIILEEVRERYQLHDRVRLLGALEHKDVRNVLVQGHIFLNTSLTEAFCMAIVEAASCGLQVVSTRVGGIPEVLPENLIILCEPSVKSLCEGLEKAIFQLKSGTLPAPENIHNIVKTFYTWRNVAERTEKVYDRVSVEAVLPMDKRLDRLISHCGPVTGYIFALLAVFNFLFLIFLRWMTPDSIIDVAIDATGPRGAWTNNYSHSKRGGENNEISETR

SEQ ID NO: 57596 - protein, 554 aa, Homo sapiens
MRRPLSKCGMEPGGGDASLTLHGLQNRSHGKIKLRKRKSTLYFNTQEKSARRRGDLLGENIYLLLFTIALRILNCFLVQTSFVPDEYWQSLEVSHHMVFNYGYLTWEWTERLRSYTYPLIFASIYKILHLLGKDSVQLLIWIPRLAQALLSAVADVRLYSLMKQLENQEVARWVFFCQLCSWFTWYCCTRTLTNTMETVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEEISAFLISSNYKRTAVFFHTHLPEGRIGSHIYVYERKLKGKFNMKMKF

SEQ ID NO: 57597 - protein, 359 aa, Homo sapiens
METVLTIIALFYYPLEGSKSMNSVKYSSLVALAFIIRPTAVILWTPLLFRHFCQEPRKLDLILHHFLPVGFVTLSLSLMIDRIFFGQWTLVQFNFLKFNVLQNWGTFYGSHPWHWYFSQGFPVILGTHLPFFIHGCYLAPKRYRILLVTVLWTLLVYSMLSHKEFRFIYPVLPFCMVFCGYSLTHLKTWKKPALSFLFLSNLFLALYTGLVHQRGTLDVMSHIQKVCYNNPNKSSASIFIMMPCHSTPYYSHVHCPLPMRFLQCPPDLTGKSHYLDEADVFYLNPLNWLHREFHDDASLPTHLITFSILEEEISAFLISSNYKRTAVFFHTHLPEGRIGSHIYVYERKLKGKFNMKMKF

SEQ ID NO: 57598 - protein, 297 aa, Homo sapiens
MYAQPVTNTKEVKWQKVLYERQPFPDNYVDRRFLEELRKNIHARKYQYWAVVFESSVVIQQLCSVCVFVVIWWYMDEGLLAPHWLLGTGLASSLIGYVLFDLIDGGEGRKKSGQTRWADLKSALVFITFTYGFSPVLKTLTESVSTDTIYAMSVFMLLGHLIFFDYGANAAIVSSTLSLNMAIFASVCLASRLPRSLHAFIMVTFAIQIFALWPMLQKKLKACTPRSYVGVTLLFAFSAVGGLLSISAVGAVLFALLLMSISCLCPFYLIRLQLFKENIHGPWDEAEIKEDLSRFLS

SEQ ID NO: 57599 - protein, 297 aa, Homo sapiens; identical to SEQ ID NO: 57598

SEQ ID NO: 57600 - protein, 297 aa, Homo sapiens; identical to SEQ ID NO: 57598

SEQ ID NO: 57601 - protein, 219 aa, Homo sapiens
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQVWPISCTLGATFGYVAGLVISPLWIYWNRKQLTYKNN

SEQ ID NO: 57602 - protein, 206 aa, Homo sapiens
MKDNDIKRLLYTHLLCIFSIILSVFIPSLFLENFSILETHLTWLCICSGFVTAVNLVLYLVVKPNTSSKRSSLSHKVTGFLKCCIYFLMSCFSFHVIFVLYGAPLIELALETFLFAVILSTFTTVPCLCLLGPNLKAWLRVFSRNGVTSIWENSLQITTISSFVGAWLGALPIPLDWERPWQMTVERKRSTYRSLHVPCRGLGTVK

SEQ ID NO: 57603 - protein, 49 aa, Homo sapiens
MKDNDIKRLLYTHLLCIFSIILSVFIPSLFLENFSILETHLTWLCICSG

SEQ ID NO: 57604 - protein, 332 aa, Homo sapiens
MAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESRYSS

SEQ ID NO: 57605 - protein, 395 aa, Homo sapiens
MAVTDSLSRAATVLATVLLLSFGSVAASHIEDQAEQFFRSGHTNNWAVLVCTSRFWFNYRHVANTLSVYRSVKRLGIPDSHIVLMLADDMACNPRNPKPATVFSHKNMELNVYGDDVEVDYRSYEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 57606 - protein, 319 aa, Homo sapiens
MAVTDSLSRAATVLATVLLLSFGSVAASHIEDQAEQFFRSGHTNNWAVLVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 57607 - protein, 301 aa, Homo sapiens
MAVTDSLSRAATVLATVLLLSFGSVAASHIEVTVENFLRVLTGRIPPSTPRSKRLLSDDRSNILIYMTGHGGNGFLKFQDSEEITNIELADAFEQMWQKRRYNELLFIIDTCQGASMYERFYSPNIMALASSQVGEDSLSHQPDPAIGVHLMDRYTFYVLEFLEEINPASQTNMNDLFQVCPKSLCVSTPGHRTDLFQRDPKNVLITDFFGSVRKVEITTETIKLQQDSEIMESSYKEDQMDEKLMEPLKYAEQLPVAQIIHQKPKLKDWHPPGGFILGLWALIIMVFFKTYGIKHMKFIF

SEQ ID NO: 57608 - protein, 252 aa, Homo sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 57609 - protein, 244 aa, Homo sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRVLCAHASVCECAAQVHLPSGSALVSASYAGCPLRAQQQRSGTGQESHVLPPQPAPLVPPPLHYLLPVHENQLTELPLKP

SEQ ID NO: 57610 - protein, 423 aa, Homo sapiens [sequence omitted]

SEQ ID NO: 57611 - protein, 931 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKTTFIFTSDHGMTDWGSHGAGHPSETLTPLVTWGAGIKYPQRVSAQQFDDAFLKEWRLENWKRLDVNQADIAPLMTSLIGVPFPLNSVGILPVDYLNNTDLFKAESMFTNAVQILEQFKVKMTQKKEVTLPFLFTPFKLLSDSKQFNILRKARSYIKHRKFDEVVSLCKELIHLALKGLSYYHTYDRFFLGVNVVIGFVGWISYASLLIIKSHSNLIKGVSKEVKKPSHLLPCSFVAIGILVAFFLLIQACPWTYYVYGLLPLPIWYAVLREFQVIQDLVVSVLTYPLSHFVGYLLAFTLGIEVLVLSFFYRYMLTAGLTAFAAWPFLTRLWTRAKMTSLSWTFFSLLLAVFPLMPVVGRKPDISLVMGAGLLVLLLSLCVVTSLMKRKDSFIKEELLVHLLQVLSTVLSMYVVYSTQSSLLRKQGLPLMNQIISWATLASSLVVPLLSSPVLFQRLFSILLSLMSTYLLLSTGYEALFPLVLSCLMFVWINIEQETLQQSGVCCKQKLTSIQFSYNTDITQFRQLYLDDIRRAFFLVFFLVTAFFGTGNIASINSFDLASVYCFLTVFSPFMMGALMMWKILIPFVLVMCAFEAVQLTTQLSSKSLFLIVLVISDIMALHFFFLVKDYGSWLDIGTSISHYVIVMSMTIFLVFLNGLAQLLTTKKLRLCGKPKSHFM

SEQ ID NO: 57612 - protein, 931 aa, Homo sapiens; identical to SEQ ID NO: 57611

SEQ ID NO: 57613 - protein, 134 aa, Homo sapiens
MVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 57614 - protein, 108 aa, Homo sapiens
MVLYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 57615 - protein, 134 aa, Homo sapiens; identical to SEQ ID NO: 57613

SEQ ID NO: 57616 - protein, 134 aa, Homo sapiens; identical to SEQ ID NO: 57613

SEQ ID NO: 57617 - protein, 25 aa, Homo sapiens
MVLYLVWAFIPESWLNSLGLTYWPQ

SEQ ID NO: 57618 - protein, 158 aa, Homo sapiens
MVPRSTSLALIVFLFHRLSKAPGKMVENSPSPLPERAIYGFVLFLSSQFGFILYLVWAFIPESWLNSLGLTYWPQKYWAVALPVYLLIAIVIGYVLLFGINMMSTSPLDSIHTITDNYAKNQQQKKYQEEAIPALRDISISEVNQMFFLAAKELYTKN

SEQ ID NO: 57619 - protein, 435 aa, Homo sapiens
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIRTPMEMRYIPLKVALFYLLNPYTILSCVAKSTCAINNTLIAFFILTTIKGSAFLSAIFLALATYQSLYPLTLFVPGLLYLLQRQYIPVKMKSKAFWIFSWEYAMMYVGSLVVIICLSFFLLSSWDFIPAVYGFILSVPDLTPNIGLFWYFFAEMFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 57620 - protein, 415 aa, Homo sapiens
MAAPLVLVLVVAVTVRAALFRSSLAEFISERVEVVSPLSSWKRVVEGLSLLDLGVSPYSGAVFHEITDALTAIALYFAIQDFNKVVFKKQKLLLELDQYAPDVAELIRTPMEMRYIPLKVALFYLLNPYTILSCVAKSTCAINNTLIAFFILTTIKGSAFLSAIFLALATYQSLYPLTLFVPGLLYLLQRQYIPVKMKSKAFWIFSWEYAMMYVGSLVVIICLSFFLLSSWDFIPAVYGFILSVPDLTPNIGLFWYFFAEMFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQILLISDYFYAFLRREYYLTHGLYLTAKDGTEAMLVLK

SEQ ID NO: 57621 - protein, 170 aa, Homo sapiens [sequence omitted]

SEQ ID NO: 57622 - protein, 423 aa, Homo sapiens
MAAPLVLVLVVAVTVRAALFRSSLAEFISERVEVVSPLSSWKRVVEGLSLLDLGVSPYSGAVFHETPLIIYLFHFLIDYAELVFMITDALTAIALYFAIQDFNKVVFKKQKLLLELDQYAPDVAELIRTPMEMRYIPLKVALFYLLNPYTILSCVAKSTCAINNTLIAFFILTTIKGSAFLSAIFLALATYQSLYPLTLFVPGLLYLLQRQYIPVKMKSKAFWIFSWEYAMMYVGSLVVIICLSFFLLSSWDFIPAVYGFILSVPDLTPNIGLFWYFFAEMFEHFSLFFVCVFQINVFFYTIPLAIKLKEHPIFFMFIQIAVIAIFKSYPTVGDVALYMAFFPVWNHLYRFLRNIFVLTCIIIVCSLLFPVLWHLWIYAGSANSNFFYAITLTFNVGQMGFCGDRMAGTCPEAIRAAGDRTPS

SEQ ID NO: 57623 - protein, 493 aa, Homo sapiens
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVASLNFLFFMLAAVALHDLGCLVLHCPHQSFYAALLFCLSPANVFLAAGYSEALFALLTFSAMGQLERGRVWTSVLLFAFATGVRSNGLVSVGFLMHSQCQGFFSSLTMLNPLRQLFKLMASLFLSVFTLGLPFALFQYYAYTQFCLPGSARPIPEPLVQLAVDKGYRIAEGNEPPWCFWDVPLIYSYIQDVYWNVGFLKYYELKQVPNFLLAAPVAILVAWATWTYVTTHPWLCLTLGLQRSKNNKTLEKPDLGFLSPQVFVYVVHAAVLLLFGGLCMHVQVLTRFLGSSTPIMYWFPAHLLQDQEPLLRSLKTVPWKPLAEDSPPGQKVPRNPIMGLLYHWKTCSPVTRYILGYFLTYWLLGLLLHCNFLPWT

SEQ ID NO: 57624 - protein, 493 aa, Homo sapiens; identical to SEQ ID NO: 57623

SEQ ID NO: 57625 - protein, 72 aa, Homo sapiens
MWPQDPSRKEVLRFAVSCRILTLMLQALFNAIIPDHHAEAFSPPRLAPSGFVDQLVEGLLGGLSHWDAEHFL

SEQ ID NO: 57626 - protein, 121 aa, Homo sapiens
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVAS

SEQ ID NO: 57627 - protein, 265 aa, Homo sapiens
MPSSQITMQKPSLLLAWPPQALWTNSWKYYAYTQFCLPGSARPIPEPLVQLAVDKGYRIAEGNEPPWCFWDVPLIYSYIQDVYWNVGFLKYYELKQVPNFLLAAPVAILVAWATWTYVTTHPWLCLTLGLQRSKNNKTLEKPDLGFLSPQVFVYVVHAAVLLLFGGLCMHVQVLTRFLGSSTPIMYWFPAHLLQDQEPLLRSLKTVPWKPLAEDSPPGQKVPRNPIMGLLYHWKTCSPVTRYILGYFLTYWLLGLLLHCNFLPWT

SEQ ID NO: 57628 - protein, 182 aa, Homo sapiens
MWPQDPSRKEVLRFAVSCRILTLMLQALFNAIIPDHHAEAFSPPRLAPSGFVDQLVEGLLGGLSHWDAEHFLFIAEHGYLYEHNFAFFPGFPLALLVGTELLRPLRGLLSLRSCLLISVASLNFLFFMLAAVALHDLGCLVLHCPHQSFYAALLFCLSPANVFLAAGYSEALFALLTFSAMG

SEQ ID NO: 57629 - protein, 504 aa, Homo sapiens
MSEKQMKEAFVSNLNGTTVLEITQGLCFPAFCILCRGFLIIFSQYLCSFSPTWKTRFLTDFVVLIVPMVATLTIWASFILLELLGVIIFGAGLLYQIYRRRTCYARLPFLKILEKFLNISLESEYNPAISCFRVITSAFTAIAILAVDFPLFPRRFAKTELYGTGAMDFGVGGFVFGSAMVCLEVRRRKYMEGSKLHYFTNSLYSVWPLVFLGIGRLAIIKSIGYQEHLTEYGVHWNFFFTIIVVKLITPLLLIIFPLNKSWIIALGITVLYQLALDFTSLKRLILYGTDGSGTRVGLLNANREGIISTLGYVAIHMAGVQTGLYMHKNRSHIKDLIKVACFLLLAAISLFISLYVVQVNVEAVSRRMANLAFCIWIVASSLILLSSLLLGDIILSFAKFLIKGALVPCSWKLIQSPVTNKKHSESLVPEAERMEPSLCLITALNRKQLIFFLLSNITTGLINLMVDTLHSSTLWALFVVNLYMFSNCLIVYVLYLQDKTVQFW

SEQ ID NO: 57630 - protein, 105 aa, Homo sapiens
MSEKQMKEAFVSNLNGTTVLEITQGLCFPAFCILCRGFLIIFSQYLCSFSPTWKTRFLTDFVVLIVPMVATLTIWASFILLELLGVIIFGAGLLYQIYRRRTCYA

SEQ ID NO: 57631 - protein, 276 aa, Homo sapiens
LAARVAAVRAAAWLLLGAATGLTRGPAAAFTAARSDAGIRAMCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQAGSRRMIRFRFDSFDKTIEFPILKCWAHSEVAAPCALENEDICQWNKMKYKSVYKNVILQVPVGLTVHTSLVCSVTLLITILCSTLILVAVFKYGHFSL

SEQ ID NO: 57632 - protein, 217 aa, Homo sapiens
MCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALENEDICQWNKMKYKSVYKNVILQVPVGLTVHTSLVCSVTLLITILCSTLILVAVFKYGHFSL

SEQ ID NO: 57633 - protein, 258 aa, Homo sapiens
LAARVAAVRAAAWLLLGAATGLTRGPAAAFTAARSDAGIRAMCSEIILRQEVLKDGFHRDLLIKVKFGESIEDLHTCRLLIKQDIPAGLYVDPYELASLRERNITEAVMVSENFDIEAPNYLSKESEVLIYARRDSQCIDCFQAFLPVHCRYHRPHSEDGEASIVVNNPDLLMFCDQEFPILKCWAHSEVAAPCALENEDICQWNKMKYKSVYKNVILQVPVGLTVHTSLVCSVTLLITILCSTLILVAVFKYGHFSL

SEQ ID NO: 57634 - protein, 168 aa, Homo sapiens
MVSENFDIEAPNYLSKESEVLIYARRDSQCIDCFQAFLPVHCRYHRPHSEDGEASIVVNNPDLLMFCDQAGSRRMIRFRFDSFDKTIEFPILKCWAHSEVAAPCALENEDICQWNKMKYKSVYKNVILQVPVGLTVHTSLVCSVTLLITILCSTLILVAVFKYGHFSL

SEQ ID NO: 57635 - protein, 579 aa, Homo sapiens
MQICGSSVASVAAGTSFQVLGPVCWQQLDLKMAVRVLWGGLSLLRVLWCLLPQTGYVHPDEFFQSPEVMAEDILGVQAARPWEFYPSSSCRSVLFPLLISGSTFWLLRLWEELGPWPGLVSGYALLVGPRLLLTALSFALDGAVYHLAPPMGADRWNALALLSGSYVTLVFYTRTFSNTIEGLLFTWLLVLVSSHVTWGPTRKEPAPGPRWRSWLLGGIVAAGFFNRPTFLAFAVVPLYLWGTRGATNPGLKSLTREALVLLPGAALTAAVFVATDSWYFSSPATSRNLVLTPVNFLHYNLNPQNLARHGTHARLTHLAVNGFLLFGVLHAQALQAAWQRLQVGLQASAQMGLLRALGARSLLSSPRSYLLLLYFMPLALLSAFSHQEARFLIPLLVPLVLLCSPQTQPVPWKGTVVLFNALGALLFGCLHQGGLVPGLEYLEQVVHAPVLPSTPTHYTLLFTHTYMPPRHLLHLPGLGAPVEVVDMGGTEDWALCQTLKSFTRQPACQVAGGPWLCRLFVVTPGTTRRAVEKCSFPFKNETLLFPHLTLEDPPALSSLLSGAWRDHLSLHIVELGEET

SEQ ID NO: 57636 - protein, 270 aa, Homo sapiens
MVLLKEYRVILPVSVDEYQVGQLYSVAEASKNETGGGEGVEVLVNEPYEKDGEKGQYTHKIYHLQSKVPTFVRMLAPEGALNIHEKAWNAYPYCRTVITNEYMKEDFLIKIETWHKPDLGTQENVHKLEPEAWKHVEAVYIDIADRSQVLSKDYKAEEDPAKFKSIKTGRGPLGPNWKQELVNQKDCPYMCAYKLVTVKFKWWGLQNKVENFIHKQERRLFTNFHRQLFCWLDKWVDLTMDDIRRMEEETKRQLDEMRQKDPVKGMTADD

SEQ ID NO: 57637 - protein, 270 aa, Homo sapiens [sequence omitted]

SEQ ID NO: 57638 - protein, 197 aa, Homo sapiens
MLAPEGALNIHEKAWNAYPYCRTVLPNEYMKEDFLIKIETWHKPDLGTQENVHKLEPEAWKHVEAVYIDIADRSQVLSKDYKAEEDPAKFKSIKTGRGPLGPNWKQELVNQKDCPYMCAYKLVTVKFKWWGLQNKVENFIHKQERRLFTNFHRQLFCWLDKWVDLTMDDIRRMEEETKRQLDEMRQKDPVKGMTADD

SEQ ID NO: 57639 - protein, 272 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETLRNQGQVRGTSAASDE

SEQ ID NO: 57640 - protein, 271 aa, Homo sapiens
MVLIKEFRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 57641 - protein, 120 aa, Homo sapiens
MIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAY

SEQ ID NO: 57642 - protein, 168 aa, Homo sapiens
MGDLLMEKCRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSV

SEQ ID NO: 57643 - protein, 273 aa, Homo sapiens
MGDLLMEKCRVVLPCSVQEYQVGQLYSVAEASKNETGGGEGIEVLKNEPYEKDGEKGQYTHKIYHLKSKVPAFVRMIAPEGSLVFHEKAWNAYPYCRTIVTNEYMKDDFFIKIETWHKPDLGTLENVHGLDPNTWKTVEIVHIDIADRSQVEPADYKADEDPALFQSVKTKRGPLGPNWKKELANSPDCPQMCAYKLVTIKFKWWGLQSKVENFIQKQEKRIFTNFHRQLFCWIDKWIDLTMEDIRRMEDETQKELETMRKRGSVRGTSAADV

SEQ ID NO: 57644 - protein, 1659 aa, Homo sapiens
MEAPSGSEPGGDGAGDCAHPDPRAPGAAAPSSGPGPCAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSKQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQGPRVEILAKNLRVKDQMPQGAPRLYRLCQPPVDGDL

SEQ ID NO: 57645 - protein, 1561 aa, Homo sapiens
MEAPSGSEPGGDGAGDCAHPDPRAPGAAAPSSGPGPCAAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTDTELQLRRDAIFCQALVAAVCTFSKQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKGELQAWGREDHGGRAKATKHTGSQPPARPRHLPSQCWRTWRGCLLQAARPRRICSRTSTRSPWRKFSSITANSGHFTWSGLTCPRMPAPRR

SEQ ID NO: 57646 - protein, 1606 aa, Homo sapiens
MSEDSRGDSRAESAKDLEKQLRLRVCVLSELQKTERDYVGTLEFLVSAFLHRMNQCAASKVDKNVTEETVKMLFSNIEDILAVHKEFLKVVEECLHPEPNAQQEVGTCFLHFKDKFRIYDEYCSNHEKAQKLLLELNKIRTIRTFLLNCMLLGGRKNTDVPLEGYLVTPIQRICKYPLILKELLKRTPRKHSDYAAVMEALQAMKAVCSNINEAKRQMEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKFSRVLKNRAWPTFKQAKSKISPLHSSDFCPTNCHVNVMEVSYPKTSTSLGSAFGVQLDSRKHNSHDKENKSSEQGKLSPMVYIQHTITTMAAPSGLSLGQQDGHGLRYLLKEEDLETQDIYQKLLGKLQTALKEVEMCVCQIDDLLSSITYSPKLERKTSEGIIPTDSDNEKGERNSKRVCFNVAGDEQEDSGHDTISNRDSYSDCNSNRNSIASFTSICSSQCSSYFHSDEMDSGDELPLSVRISHDKQDKIHSCLEHLFSQVDSITNLLKGQAVVRAFDQTKYLTPGRGLQEFQQEMEPKLSCPKRLRLHIKQDPWNLPSSVRTLAQNIRKFVEEVKCRLLLALLEYSDSETQLRRDMVFCQTLVATVCAFSEQLMAALNQMFDNSKENEMETWEASRRWLDQIANAGVLFHFQSLLSPNLTDEQAMLEDTLVALFDLEKVSFYFKPSEEEPLVANVPLTYQAEGSRQALKVYFYIDSYHFEQLPQRLKNGGGFKIHPVLFAQALESMEGYYYRDNVSVEEFQAQINAASLEKVKQYNQKLRAFYLDKSNSPPNSTSKAAYVDKLMRPLNALDELYRLVASFIRSKRTAACANTACSASGVGLLSVSSELCNRLGACHIIMCSSGVHRCTLSVTLEQAIILARSHGLPPRYIMQATDVMRKQGARVQNTAKNLGVRDRTPQSAPRLYKLCEPPPPAGEE

SEQ ID NO: 57647 - protein, 1174 aa, Homo sapiens
MSEDSRGDSRAESAKDLEKQLRLRVCVLSELQKTERDYVGTLEFLVSAFLHRMNQCAASKVDKNVTEETVKMLFSNIEDILAVHKEFLKVVEECLHPEPNAQQEVGTCFLHFKDKFRIYDEYCSNHEKAQKLLLELNKIRTIRTFLLNCMLLGGRKNTDVPLEGYLVTPIQRICKYPLILKELLKRTPRKHSDYAAVMEALQAMKAVCSNINEAKRQMEKLEVLEEWQSHIEGWEGSNITDTCTEMLMCGVLLKISSGNIQERVFFLFDNLLVYCKRKHRRLKNSKASTDGHRYLFRGRINTEVMEVENVDDGTADFHSSGHIVVNGWKIHNTAKNKWFVCMAKTPEEKHEWFEAILKERERRKGLKLGMEQDTWVMISEQGEKLYKMMCRQGNLIKDRKRKLTTFPKCFLGSEFVSWLLEIGEIHRPEEGVHLGQALLENGIIHHVTDKHQFKPEQMLYRFRYDDGTFYPRNEMQDVISKGVRLYCRLHSLFTPVIRDKDYHLRTYKSVVMANKLIDWLIAQGDCRTREEAMIFGVGLCDNGFMHHVLEKSEFKDEPLLFRFFSDEEMEGSNMKHRLMKHDLKVVENVIAKSLLIKSNEGSYGFGLEDKNKVPIIKLVEKGSNAEMAGMEVGKKIFAINGDLVFMRPFNEVDCFLKSCLNSRKPLRVLVSTKPRETVKIPDSADGLGFQIRGFGPSVVHAVGRGTVAAAAGLHPGQCIIKVNGINVSKETHASVIAHVTACRKYRRPTKQDSIQWVYNSIESAQEDLQKSHSKPPGDEAGDAFDCKVEEVIDKFNTMAIIDGKKEHVSLTVDNVHLEYGVVYEYDSTAGIKCNVVEKMIEPKGFFSLTAKILEALAKSDEHFVQNCTSLNSLNEVIPTDLQSKFSALCSERIEHLCQRISSYKKVSVLLILYTIIVEMYHFTEMITLYNILELVRPPNSEFFFSFLPTKRMKTLNQKKVTHMKKTNIQLQFSRVLKNRAWPTFKQAKSKISPLHSSDFCPTNCHVNVMEVSYPKTSTSLGSAFGVQWKLSPMVYIQHTITTMAAPSGLSLGQQDGHGLRYLLERKTSEGIIPTDSDNEKGERNSKRVCFNVAGDEQEDSGHDTISNRDSYSFSDCNSNRNSIASFTSICSSQCSSYFHSDEMDSGSDELPLSVRISHDKQDKIHSCLEHLFSQ

SEQ ID NO: 57648 - protein, 549 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 57649 - protein, 562 aa, Homo sapiens
MASASSGPSSSVGFSSFDPAVPSCTLSSAASGIKRPMASEVLEARQDSYISLVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 57650 - protein, 500 aa, Homo sapiens
MASASSGPSSSVGFSSFDPAVPSCTLSSASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPCVHLGRPDVLPQTPPLEEISEGSPIPDPSFSPLVGETLQMLTTSTTLEKLEVAESEFTH

SEQ ID NO: 57651 - protein, 550 aa, Homo sapiens
MASASSGPSSSVGFSSFDPAVPSCTLSSAASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 57652 - protein, 198 aa, Homo sapiens
MYNALCKTLQRDCLVLQSFKIMDYSLLMSIHNIDHAQREPLSSETQYSVDTRRPAPQKALYSTAMESIQGEARRGGTMETDDHMGGIPARNSKGERLLLYIGIIDILQSYRFVKKLEHSWKALVHDGDTVSVHRPGFYAERFQRFMCNTVFKKIPLQPWKSLKLQSQSSPIKRKASEDLEQDSAISVIPRCQPLPQQC

SEQ ID NO: 57653 - protein, 86 aa, Homo sapiens
MASEVLEARQDSYISLVPYASGMPIKKIGHRSVDSSGETTYKKTTSSALKGAIQLGITHTVGSLSTKPERDVLMQDFYVVESIFFP

SEQ ID NO: 57654 - protein, 522 aa, Homo sapiens
MASASSGPSSSVGFSSFDPAVPSCTLSSAASGIKRPMASEVPYASGMPIKKIGHRSVDSSGETTYKKTTSSALKGAIQLGITHTVGSLSTKPERDVLMQDFYVVESIFFPSEGSNLTPAHHYNDFRFKTYAPVAFRYFRELFGIRPDDYLYSLCSEPLIELCSSGASGSLFYVSSDDEFIIKTVQHKEAEFLQKLLPGYYMNLNQNPRTLLPKFYGLYCVQAGGKNIRIVVMNNLLPRSVKMHIKYDLKGSTYKRRASQKEREKPLPTFKDLDFLQDIPDGLFLDADMYNALCKTLQRDCLVLQSFKIMDYSLLMSIHNIDHAQREPLSSETQYSVDTRRPAPQKALYSTAMESIQGEARRGGTMETDDQFVKKLEHSWKALVHDGDTVSVHRPGFYAERFQRFMCNTVFKKIPLKPSPSKKFRSGSSFSRRAGSSGNSCITYQPSVSGEHKAQVTTKAEVEPGVHLGRPDVLPQTPPLEEISEGSPIPDPSFSPLVGETLQMLTTSTTLEKLEVAESEFTH

SEQ ID NO: 57655 - protein, 540 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNSKGLPSSSTFTLEEGTIYLTAEPNTLEVQDDNASVLDVYL

SEQ ID NO: 57656 - protein, 103 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPD

SEQ ID NO: 57657 - protein, 540 aa, Homo sapiens; identical to SEQ ID NO: 57655

SEQ ID NO: 57658 - protein, 449 aa, Homo sapiens
MQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNSK

SEQ ID NO: 57659 - protein, 162 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQN

SEQ ID NO: 57660 - protein, 157 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYM

SEQ ID NO: 57661 - protein, 502 aa, Homo sapiens
MSSAAENGEAAPGKQNEEKTYKKTASSAIKGAIQLGIGYTVGNLTSKPERDVLMQDFYVVESVFLPSEGSNLTPAHHYPDFRFKTYAPLAFRYFRELFGIKPDDYLYSICSEPLIELSNPGASGSLFFVTSDDEFIIKTVQHKEAEFLQKLLPGYYMNLNQNPRTLLPKFYGLYCMQSGGINIRIVVMNNVLPRSMRMHFTYDLKGSTYKRRASRKEREKSNPTFKDLDFLQDMHEGLYFDTETYNALMKTLQRDCRVLESFKIMDYSLLLGIHFLDHSLKEKEEETPQNVPDAKRTGMQKVLYSTAMESIQGPGKSGDGIITENPDTMGGIPAKSHRGEKLLLFMGIIDILQSYRLMKKLEHSWKALVYDGDTVSVHRPSFYADRFLKFMNSRVFKKIQALKASPSKKRCNSIAALKATSQEIVSSISQEWKDEKRDLLTEGQSFSSLDEEALGSRHRPDLVPSTPSLFEAASLATTISSSSLYVNEHYPHDRPTLYSNSK

SEQ ID NO: 57662 - protein, 668 aa, Homo sapiens
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFPTDERSWVYSPLHYSAQAPPASDGESDT

SEQ ID NO: 57663 - protein, 700 aa, Homo sapiens
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYFWRLWGPHAPTWPWRREGRAACLCPYPPHVVTPFPGTGLCASWSPDGTGGLGAMSCCVSVS

SEQ ID NO: 57664 - protein, 640 aa, Homo sapiens
MELEVPDEAESAEAGAVPSEAAWAAESGAAAGLAQKKAAPTEVLSMTAQPGPGHGKKLGHRGVDASGETTYKKTTSSTLKGAIQLGIGYTVGHLSSKPERDVLMQDFYVVESIFFPSEGSNLTPAHHFQDFRFKTYAPVAFRYFRELFGIRPDDYLYSLCNEPLIELSNPGASGSLFYVTSDDEFIIKTVMHKEAEFLQKLLPGYYMNLNQNPRTLLPKFYGLYCVQSGGKNIRVVVMNNILPRVVKMHLKFDLKGSTYKRRASKKEKEKSFPTYKDLDFMQDMPEGLLLDADTFSALVKTLQRDCLVLESFKIMDYSLLLGVHNIDQHERERQAQGAQSTSDEKRPVGQKALYSTAMESIQGGAARGEAIESDDTMGGIPAVNGRGERLLLHIGIIDILQSYRFIKKLEHTWKALVHDGDTVSVHRPSFYAERFFKFMSNTVFRKNSSLKSSPSKKGRGGALLAVKPLGPTAAFSASQIPSEREEAQYDLRGARSYPTLEDEGRPDLLPCTPPSFEEATTASIATTLSSTSLSIPERSPSETSEQPRYRRRTQSSGQDGRPQEEPPAEEDLQQITVQVEPACSVEIVVPKEEDAGVEASPAGASAAVEVETASQASDEEGAPASQASDEEDAPATDIYF

SEQ ID NO: 57665 - protein, 191 aa, Homo sapiens
MQSVFYPAGRISERYDIKGCEVSRWVDPAPEGSPLVLVLKDLNFQGKTINLGPQRSWFLRQMELDTTFLRELNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 57666 - protein, 394 aa, Homo sapiens
MAAPSPGPREVLAPSPEAGCRAVTSSRRGLLWRLRDKQSRLGLFEISPGHELHGMTCMMQAGLWAATQVSMDHPPTGPPSRDDFSEVLTQVHEGFELGTLAGPAFAWLRRSLGLAEEDYQAALGPGGPYLQFLSTSKSKASFFLSHDQRFFLKTQGRREVQALLAHLPRYVQHLQRHPHSLLARLLGVHSLRVDRGKKTYFIVMQSVFYPAGRISERYDIKGCEVSRWVDPAPEGSPLVLVLKDLNFQGKTINLGPQRSWFLRQMELDTTFLRELNVLDYSLLIAFQRLHEDERGPGSSLIFRTARSVQGAQSPEESRAQNRRLLPDAPNALHILDGPEQRYFLGVVDLATVYGLRKRLEHLWKTLRYPGRTFSTVSPARYARRLCQWVEAHTE

SEQ ID NO: 57667 - protein, 375 aa, Homo sapiens
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 57668 - protein, 408 aa, Homo sapiens
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 57669 - protein, 375 aa, Homo sapiens; identical to SEQ ID NO: 57667

SEQ ID NO: 57670 - protein, 262 aa, Homo sapiens
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGPAHKQPKAQQGLLQ

SEQ ID NO: 57671 - protein, 228 aa, Homo sapiens
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGD

SEQ ID NO: 57672 - protein, 73 aa, Homo sapiens
MMCQSEARQGPELRAAKWLHFPQLALRRRLGQLSCMSRPALKLRSWPLTVLYYLLPFGALRPLSRVGWRPVSR

SEQ ID NO: 57673 - protein, 73 aa, Homo sapiens; identical to SEQ ID NO: 57672

SEQ ID NO: 57674 - protein, 409 aa, Homo sapiens
MATSVGHRCLGLLHGVAPWRSSLHPCEITALSQSLQPLRKLPFRAFRTDARKIHTAPARTMFLLRPLPILLVTGGGYAGYRQYEKYRERELEKLGLEIPPKLAGHWEVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSFVTHTNREGVPMRKGEHLGEFNLGSTIVLIFEAPKDFNFQLKTGQKIRFGEALGSL

SEQ ID NO: 57675 - protein, 81 aa, Homo sapiens
MMCQSEARQGPELRAAKWLHFPQLALRRRLGQLSCMSRPALKLRSWPLTVLYYLLPFGALRPLSRVGWRPVSRVALYKSVP

SEQ ID NO: 57676 - protein, 326 aa, Homo sapiens
MMCQSEARQGPELRAAKWLHFPQLALRRRLGQLSCMSRPALKLRSWPLTVLYYLLPFGALRPLSRVGWRPVSRVALYKSVPTRLLSRAWGRLNQVELPHWLRRPVYSLYIWTFGVNMKEAAVEDLHHYRNLSEFFRRKLKPQARPVCGLHSVISPSDGRILNFGQVKNCEVEQVKGVTYSLESFLGPRMCTEDLPFPPAASCDSFKNQLVTREGNELYHCVIYLAPGDYHCFHSPTDWTVSHRRHFPGSLMSVNPGMARWIKELFCHNERVVLTGDWKHGFFSLTAVGATNVGSIRIYFDRDLHTNSPRHSKGSYNDFSVVGSLTR

SEQ ID NO: 57677 - protein, 327 aa, Homo sapiens
MEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGNNESHSSRRRNRHSKSKVTNGVGKK

SEQ ID NO: 57678 - protein, 473 aa, Homo sapiens
MASCVGSRTLSKDDVNYKMHFRMINEQQVEDITIDFFYRPHTITLLSFTIVSLMYFAFTRDDSVPEDNIWRGILSVIFFFLIISVLAFPNGPFTRPHPALWRMVFGLSVLYFLFLVFLLFLNFEQVKSLMYWLDPNLRYATREADVMEYAVNCHVITWERIISHFDIFAFGHFWGWAMKALLIRSYGLCWTISITWELTELFFMHLLPNFAECWWDQVILDILLCNGGGIWLGMVVCRFLEMRTYHWASFKDIHTTTGKIKRAVLQFTPASWTYVRWFDPKSSFQRVAGVYLFMIIWQLTELNTFFLKHIFVFQASHPLSWGRILFIGGITAPTVRQYYAYLTDTQCKRVGTQCWVFGVIGFLEAIVCIKFGQDLFSKTQILYVVLWLLCVAFTTFLCLYGMIWYAEHYGHREKTYSECEDGTYSPEISWHHRKGTKGSEDSPPKHAGNNESHSSRRRNRHSKSKVTNGVGKK

SEQ ID NO: 57679 - protein, 487 aa, Homo sapiens
MRRGERRDAGGPRPESPVPAGRASLEEPPDGPSAGQATGPGEGRRSTESEVYDDGTNTFFWRAHTLTVLFILTCTLGYVTLLEETPQDTAYNTKRGIVASILVFLCFGVTQAKDGPFSRPHPAYWRFWLCVSVVYELFLIFILFQTVQDGRQFLKYVDPKLGVPLPERDYGGNCLIYDPDNETDPFHNIWDKLDGFVPAHFLGWYLKTLMIRDWWMCMIISVMFEFLEYSLEHQLPNFSECWWDHWIMDVLVCNGLGIYCGMKTLEWLSLKTYKWQGLWNIPTYKGKMKRIAFQFTPYSWVRFEWKPASSLRRWLAVCGIILVFLLAELNTFYLKFVLWMPPEHYLVLLRLVFFVNVGGVAMREIYDFMDDPKPHKKLGPQAWLVAAITATELLIVVKYDPHTLTLSLPFYISQCWTLGSVLALTWTVWRFFLRDITLRYKETRWQKWQNKDDQGSTVGNGDQHPLGLDEDLLGPGVAEGEGAPTPN

SEQ ID NO: 57680 - protein, 933 aa, Homo sapiens
MAASRLDFGEVETFLDRHPELFEDYLMRKGKQEMVEKWLQRHSQGQGALGPRPSLAGTSSLAHSTCRGGSSVGGGTGPNGSAHSQPLPGGGDCGGVPLSPSWAGGSRGDGNLQRRASQKELRKSFARSKAIHVNRTYDEQVTSRAQEPLSSVRRRALLRKASSLPPTTAHILSALLESRVNLPRYPPTAIDYKCHLKKHNERQFFLELVKDISNDLDLTSLSYKILIFVCLMVDADRCSLFLVEGAAAGKKTLVSKFFDVHAGTPLLPCSSTENSNEVQVPWGKGIIGYVGEHGETVNIPDAYQDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 57681 - protein, 683 aa, Homo sapiens
MLKQARRPLFRNVLSATQWKKVKITRLVQISGASLAEKQEKHQDFLIQRQTKTKDRRFNDEIDKLTGYKTKSLLCMPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 57682 - protein, 489 aa, Homo sapiens
MSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 57683 - protein, 575 aa, Homo sapiens
MQMYLPFCGIAISNAQLFAASRKEYERSRALLEVVNDLFEEQTDLEKIVKKIMHRAQTLLKCERCSVLLLEDIESPVVKFTKSFELMSPKCSADAENSFKESMEKSSYSDWLINNSIAELVASTGLPVNISDAYQDPRFDAEADQISGFHIRSVLCVPIWNSNHQIIGVAQVLNRLDGKPFDDADQRLFEAFVIFCGLGINNTIMYDQVKKSWAKQSVALDVLSYHATCSKAEVDKFKAANIPLVSELAIDDIHFDDFSLDVDAMITAALRMFMELGMVQKFKIDYETLCRWLLTVRKNYRMVLYHNWRHAFNVCQLMFAMLTTAGFQDILTEVEILAVIVGCLCHDLDHRGTNNAFQAKSGSALAQLYGTSATLEHHHFNHAVMILQSEGHNIFANLSSKEYSDLMQLLKQSILATDLTLYFERRTEFFELVSKGEYDWNIKNHRDIFRSMLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 57684 - protein, 130 aa, Homo sapiens
MPIRSSDGEIIGVAQAINKIPEGAPFTEDDEKVMQMYLPFCGIAISNAQLFAASRKEYERSRALLEVVNDLFEEQTDLEKIVKKIMHRAQTLLKCERCSVLLLEDIESPVVKFTKSFELMSPKCSADAEN

SEQ ID NO: 57685 - protein, 575 aa, Homo sapiens; identical to SEQ ID NO: 57683

SEQ ID NO: 57686 - protein, 124 aa, Homo sapiens
MLMTACDLGAVTKPWEISRQVAELVTSEFFEQGDRERLELKLTPSAIFDRNRKDELPRLQLEWIDSICMPLYQALVKVNVKLKPMLDSVATNRSKWEELHQKRLLASTASSSPASVMVAKEDRN

SEQ ID NO: 57687 - protein, 545 aa, Homo sapiens
MGSSATEIEELENTTFKYLTGEQTEKMWQRLKGILRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 57688 - protein, 511 aa, Homo sapiens
MGKKINKLFCFNFLVQCFRGKSKPSKCQIRKKVKNHIERLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 57689 - protein, 519 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 57690 - protein, 535 aa, Homo sapiens
MGSSATEIEELENTTFKYLTGEQTEKMWQRLKGILRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQEARTSSQKCEFIHQ

SEQ ID NO: 57691 - protein, 529 aa, Homo sapiens
MDDHVTIRKKHLQRPIFRLRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 57692 - protein, 535 aa, Homo sapiens; identical to SEQ ID NO: 57690

SEQ ID NO: 57693 - protein, 545 aa, Homo sapiens; identical to SEQ ID NO: 57687

SEQ ID NO: 57694 - protein, 552 aa, Homo sapiens
MGSSATEIEELENTTFKYLTGEQTEKMWQRLKGILRCLVKQLERGDVNVVDLKKNIEYAASVLEAVYIDETRRLLDTEDELSDIQTDSVPSEVRDWLASTFTRKMGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGSVVYEALLPSLSVFTSPLRVWITSSRFLLL

SEQ ID NO: 57695 - protein, 441 aa, Homo sapiens
MGMTKKKPEEKPKFRSIVHAVQAGIFVERMYRKTYHMVGLAYPAAVIVTLKDVDKWSFDVFALNEASGEHSLKFMIYELFTRYDLINRFKIPVSCLITFAEALEVGYSKYKNPYHNLIHAADVTQTVHYIMLHTGIMHWLTELEILAMVFAAAIHDYEHTGTTNNFHIQTRSDVAILYNDRSVLENHHVSAAYRLMQEEEMNILINLSKDDWRDLRNLVIEMVLSTDMSGHFQQIKNIRNSLQQPEGIDRAKTMSLILHAADISHPAKSWKLHYRWTMALMEEFFLQGDKEAELGLPFSPLCDRKSTMVAQSQIGFIDFIVEPTFSLLTDSTEKIVIPLIEEASKAETSSYVASSSTTIVGLHIADALRRSNTKGSMSDGSYSPDYSLAAVDLKSFKNNLVDIIQQNKERWKELAAQGESDLHKNSEDLVNAEEKHDETHS

SEQ ID NO: 57696 - protein, 536 aa, Homo sapiens
MELSPRSPPEMLEESDCPSPLELKSAPSKKMWIKLRSLLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 57697 - protein, 495 aa, Homo sapiens
MVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 57698 - protein, 516 aa, Homo sapiens
MANPVPVQRSHLQGPILRLRYMVKQLENGEINIEELKKNLEYTASLLEAVYIDETRQILDTEDELQELRSDAVPSEVRDWLASTFTQQARAKGRRAEEKPKFRSIVHAVQAGIFVERMFRRTYTSVGPTYSTAVLNCLKNLDLWCFDVFSLNQAADDHALRTIVFELLTRHNLISRFKIPTVFLMSFLDALETGYGKYKNPYHNQIHAADVTQTVHCFLLRTGMVHCLSEIELLAIIFAAAIHDYEHTGTTNSFHIQTKSECAIVYNDRSVLENHHISSVFRLMQDDEMNIFINLTKDEFVELRALVIEMVLATDMSCHFQQVKTMKTALQQLERIDKPKALSLLLHAADISHPTKQWLVHSRWTKALMEEFFRQGDKEAELGLPFSPLCDRTSTLVAQSQIGFIDFIVEPTFSVLTDVAEKSVQPLADEDSKSKNQPSFQWRQPSLDVEVGDPNPDVVSFRSTWVKRIQENKQKWKERAASGITNQMSIDELSPCEEEAPPSPAEDEHNQNGNLD

SEQ ID NO: 57699 - protein, 769 aa, Homo sapiens
MTDAGNRKEGFKKCRSATFSIDGYSFTIVANEAGDKNARPLARFSRSKSQNCLWNSLIDGLTGNVKEKPRPTIVHDPRPPEEILADELPQLDSSEVLVKTSFRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 57700 - protein, 709 aa, Homo sapiens
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDGTKQRSHGSPAPSTSSTCRLTLPVIKPPLRHFKRPAYASSSYAPSVSKKTDEHPARYKMLDQRIKMKKIQNISHNWNRK

SEQ ID NO: 57701 - protein, 634 aa, Homo sapiens
MESPTKEIEEFESNSLKYLQPEQIEKIWLRLRGLRKYKKTSQRLRSLVKQLERGEASVVDLKKNLEYAATVLESVYIDETRRLLDTEDELSDIQSDAVPSEVRDWLASTFTRQMGMMLRRSDEKPRFKSIVHAVQAGIFVERMYRRTSNMVGLSYPPAVIEALKDVDKWSFDVFSLNEASGDHALKFIFYELLTRYDLISRFKIPISALVSFVEALEVGYSKHKNPYHNLMHAADVTQTVHYLLYKTGVANWLTELEIFAIIFSAAIHDYEHTGTTNNFHIQTRSDPAILYNDRSVLENHHLSAAYRLLQDDEEMNILINLSKDDWREFRTLVIEMVMATDMSCHFQQIKAMKTALQQPEAIEKPKALSLMLHTADISHPAKAWDLHHRWTMSLLEEFFRQGDREAELGLPFSPLCDRKSTMVAQSQVGFIDFIVEPTFTVLTDMTEKIVSPLIDETSQTGGTGQRRSSLNSISSSDAKRSGVKTSGSEGSAPINNSVISVDYKSFKATWTEVVHINRERWRAKVPKEEKAKKEAEEKARLAAEEQQKEMEAKSQAEEGASGKAEKKTSGETKNQVNGTRANKSDNPRGKNSKAEKSSGEQQQNGDFKDGKNKTDKKDHSNIGNDSKKTDDSQE

SEQ ID NO: 57702 - protein, 634 aa, Homo sapiens; identical to SEQ ID NO: 57701

SEQ ID NO: 57703 - protein, 46 aa, Homo sapiens
MESPTKEIEEFESNSLKYLQPEQIEKIWLRLRGLRKYKKTSQRLRS

SEQ ID NO: 57704 - protein, 709 aa, Homo sapiens; identical to SEQ ID NO: 57700

SEQ ID NO: 57705 - protein, 1112 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQVISSLRSISSLMGAFSGSCRPKINPLTPFPGFYPCSEIEDPAEKGDRKLNKGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 57706 - protein, 1061 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGAGCLLALGLDHFFQIREAPLHPRLSSAAEEKVPVIRPRRRSSCVSLGETAASYYGSCKIFRRPSLPCISREQMILWDWDLKQWYKPHYQNSGGGNGVDLSVLNEARNMVSDLLTDPSLPPQGLNRNSLPTPQLRRSSGTSGLLPVEQSSRWDRNNGKRPHQEFGISSQGCYLNGPFNSNLLTIPKQRSSSVSLTHHVGLRRAGVLSSLSPVNSSNHGPVSTGSLTNRSPIEFPDTADFLNKPSVILQRSLGNAPNTPDFYQQLRNSDSNLCNSCGHQMLKYVSTSESDGTDCCSGKSGEEENIFSKESFKLMETQQEEETEKKDSRKLFQEGDKWLTEEAQSEQQTNIEQEVSLDLILVEEYDSLIEKMSNWNFPIFELVEKMGEKSGRILSQVMYTLFQDTGLLEIFKIPTQQFMNYFRALENGYRDIPYHNRIHATDVLHAVWYLTTRPVPGLQQIHNGCGTGNETDSDGRINHGRIAYISSKSCSNPDESYGCLSSNIPALELMALYVAAAMHDYDHPGRTNAFLVATNAPQAVLYNDRSVLENHHAASAWNLYLSRPEYNFLLHLDHVEFKRFRFLVIEAILATDLKKHFDFLAEFNAKANDVNSNGIEWSNENDRLLVCQVCIKLADINGPAKVRDLHLKWTEGIVNEFYEQGDEEANLGLPISPFMDRSSPQLAKLQESFITHIVGPLCNSYDAAGLLPGQWLEAEEDNDTESGDDEDGEELDTEDEEMENNLNPKPPRRKSRRRIFCQLMHHLTENHKIWKEIVEEEEKCKADGNKLQVENSSLPQADEIQVIEEADEEE

SEQ ID NO: 57707 - protein, 860 aa, Homo sapiens
MARPRGLGRIPELQLVAFPVAVAAEDEAFLPEPLAPRAPRRPRSPPSSPVFFASPSPTFRRRLRLLRSCQDLGRQAWAGAGFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 57708 - protein, 647 aa, Homo sapiens
MPLVDFFCETCSKPWLVGWWDQFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 57709 - protein, 886 aa, Homo sapiens
MEPPTVPSERSLSLSLPGPREGQATLKPPPQHLWRQPRTPIRIQQRGYSDSAERAERERQPHRPIERADAMDTSDRPGLRTTRMSWPSSFHGTGTGSGGAGGGSSRRFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 57710 - protein, 323 aa, Homo sapiens
MVLPSDQGFKLLGNVLQGPEPYRLLTSGLRLHQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVQARGIDGRAQGEFY

SEQ ID NO: 57711 - protein, 864 aa, Homo sapiens
MKRSRSALSVAGTGDERSRETPESDRANMLGADLRRPRRRLSSGPGLGWAQPEPSDPGVPLPPRPTTLPLLIPPRISITRAENDSFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 57712 - protein, 102 aa, Homo sapiens
MVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADL

SEQ ID NO: 57713 - protein, 825 aa, Homo sapiens
MRSGAAPRARPRPPALALPPTGPESLTHFPFSDEDTRRHPPGRSVSFEAENGPTPSPGRSPLDSQASPGLVLHAGAATSQRRESFLYRSDSDYDMSPKTMSRNSSVTSEAHAEDLIVTPFAQVLASLRSVRSNFSLLTNVPVPSNKRSPLGGPTPVCKATLSEETCQQLARETLEELDWCLEQLETMQTYRSVSEMASHKFKRMLNRELTHLSEMSRSGNQVSEYISTTFLDKQNEVEIPSPTMKEREKQQAPRPRPSQPPPPPVPHLQPMSQITGLKKLMHSNSLNNSNIPRFGVKTDQEELLAQELENLNKWGLNIFCVSDYAGGRSLTCIMYMIFQERDLLKKFRIPVDTMVTYMLTLEDHYHADVAYHNSLHAADVLQSTHVLLATPALDAVFTDLEILAALFAAAIHDVDHPGVSNQFLINTNSELALMYNDESVLENHHLAVGFKLLQEDNCDIFQNLSKRQRQSLRKMVIDMVLATDMSKHMTLLADLKTMVETKKVTSSGVLLLDNYSDRIQVLRNMVHCADLSNPTKPLELYRQWTDRIMAEFFQQGDRERERGMEISPMCDKHTASVEKSQVGFIDYIVHPLWETWADLVHPDAQEILDTLEDNRDWYYSAIRQSPSPPPEEESRGPGHPPLPDKFQFELTLEEEEEEEISMAQIPCTAQEALTAQGLSGVEEALDATIAWEASPAQESLEVMAQEASLEAELEAVYLTQQAQSTGSAPVAPDEFSSREEFVVAVSHSSPSALALQSPLLPAWRTLSVSEHAPGLPGLPSTAAEVEAQREHQAAKRACSACAGTFGEDTSALPAPGGGGSGGDPT

SEQ ID NO: 57714 - protein, 736 aa, Homo sapiens
MKKSRSVMTVMADDNVKDYFECSLSKSYSSSSNTLGIDLWRGRRCCSGNLQLPPLSQRQSERARTPEGDGISRPTTLPLTTLPSIAITTVSQECFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 57715 - protein, 736 aa, Homo sapiens; identical to SEQ ID NO: 57714

SEQ ID NO: 57716 - protein, 564 aa, Homo sapiens
MKEHGGTFSSTGISGGSGDSAMDSLQPLQPNYMPVCLFAEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 57717 - protein, 736 aa, Homo sapiens; identical to SEQ ID NO: 57714

SEQ ID NO: 57718 - protein, 721 aa, Homo sapiens
MTAKDSSKELTASEPEVCIKTFKEQMHLELELPRLPGNRPTSPKISPRSSPRNSPCFFRKLLVNKSIRQRRRFTVAHTCFDVENGPSPGRSPLDPQASSSAGLVLHATFPGHSQRRESFLYRSDSDYDLSPKAMSRNSSLPSEQHGDDLIVTPFAQVLASLRSVRNNFTILTNLHGTSNKRSPAASQPPVSRVNPQEESYQKLAMETLEELDWCLDQLETIQTYRSVSEMASNKFKRMLNRELTHLSEMSRSGNQVSEYISNTFLDKQNDVEIPSPTQKDREKKKKQQLMTQISGVKKLMHSSSLNNTSISRFGVNTENEDHLAKELEDLNKWGLNIFNVAGYSHNRPLTCIMYAIFQERDLLKTFRISSDTFITYMMTLEDHYHSDVAYHNSLHAADVAQSTHVLLSTPALDAVFTDLEILAAIFAAAIHDVDHPGVSNQFLINTNSELALMYNDESVLENHHLAVGFKLLQEEHCDIFMNLTKKQRQTLRKMVIDMVLATDMSKHMSLLADLKTMVETKKVTSSGVLLLDNYTDRIQVLRNMVHCADLSNPTKSLELYRQWTDRIMEEFFQQGDKERERGMEISPMCDKHTASVEKSQVGFIDYIVHPLWETWADLVQPDAQDILDTLEDNRNWYQSMIPQSPSPPLDEQNRDCQGLMEKFQFELTLDEEDSEGPEKEGEGHSYFSSTKTLCVIDPENRDSLGETDIDIATEDKSPVDT

SEQ ID NO: 57719 - protein, 680 aa, Homo sapiens
MQGPPAPAPVPGPGSPRGSPRGSPGLFRKLLVNQSIRLQRRFTVAHPLCFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57720 - protein, 426 aa, Homo sapiens
MASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57721 - protein, 712 aa, Homo sapiens
MENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57722 - protein, 606 aa, Homo sapiens
MQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57723 - protein, 791 aa, Homo sapiens
GTQAGLRSGAPSGHRQLLGVGPTLSPSSTFYRFSTSGADSSSLSPPLPALGRTREQTLLGARSRGRVLLPAIPDPFLWRMENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57724 - protein, 700 aa, Homo sapiens
AVQKRSRAAGARSSLHAVLAMQGPPAPAPVPGPGSPRGSPRGSPGLFRKLLVNQSIRLQRRFTVAHPLCFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57725 - protein, 481 aa, Homo sapiens
MASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57726 - protein, 821 aa, Homo sapiens
MQRYRGRQTVFGAGVLGGVSSAPSFNTPSPRSSPLFYPSAPSGHRQLLGVGPTLSPSSTFYRFSTSGADSSSLSPPLPALGRTREQTLLGARSRGRVLLPAIPDPFLWRMENLGVGEGAEACSRLSRSRGRHSMTRAPKHLWRQPRRPIRIQQRFYSDPDKSAGCRERDLSPRPELRKSRLSWPVSSCRRFDLENGLSCGRRALDPQSSPGLGRIMQAPVPHSQRRESFLYRSDSDYELSPKAMSRNSSVASDLHGEDMIVTPFAQVLASLRTVRSNVAALARQQCLGAAKQGPVGNPSSSNQLPPAEDTGQKLALETLDELDWCLDQLETLQTRHSVGEMASNKFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57727 - protein, 518 aa, Homo sapiens
PLRIRPLLPTAYHLLPTGPGQSADRSEQRGGPCPPAMPRSSQFKRILNRELTHLSETSRSGNQVSEYISRTFLDQQTEVELPKVTAEEAPQPMSRISGLHGLCHSASLSSATVPRFGVQTDQEEQLAKELEDTNKWGLDVFKVAELSGNRPLTAIIFSIFQERDLLKTFQIPADTLATYLLMLEGHYHANVAYHNSLHAADVAQSTHVLLATPALEAVFTDLEILAALFASAIHDVDHPGVSNQFLINTNSELALMYNDASVLENHHLAVGFKLLQAENCDIFQNLSAKQRLSLRRMVIDMVLATDMSKHMNLLADLKTMVETKKVTSLGVLLLDNYSDRIQVLQNLVHCADLSNPTKPLPLYRQWTDRIMAEFFQQGDRERESGLDISPMCDKHTASVEKSQVGFIDYIAHPLWETWADLVHPDAQDLLDTLEDNREWYQSKIPRSPSDLTNPERDGPDRFQFELTLEEAEEEDEEEEEEGEETALAKEALELPDTELLSPEAGPDPGDLPLDNQRT

SEQ ID NO: 57728 - protein, 2240 aa, Homo sapiens
MEQTWTRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGCLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGELDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPWKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 57729 - protein, 1132 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGCLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQL

SEQ ID NO: 57730 - protein, 173 aa, Homo sapiens
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDK

SEQ ID NO: 57731 - protein, 310 aa, Homo sapiens
MKGTDSGSCCRRRCDFGCCCRASRRAHYTPYRSGDATRTPQSPRQTPSRERRRPEPAGSWAAAAEEEEAAAAATPWMRDYFAEDDGEMVPRTSHTAAFLSDTKDRGPPVQSQIWRSGEKVPFVQTYSLRAFEKPPQVQTQALRDFEKHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDK

SEQ ID NO: 57732 - protein, 969 aa, Homo sapiens
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGCLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQL

SEQ ID NO: 57733 - protein, 988 aa, Homo sapiens [sequence omitted]

SEQ ID NO: 57734 - protein, 1131 aa, Homo sapiens
MKEICRICARELCGNQRRWIFHTASKLNLQVLLSHVLGKDVPRDGKAEFACSKCAFMLDRIYRFDTVIARIEALSIERLQKLLLEKDRLKFCIASMYRKNNDDSGAEIKAGNGTVDMSVLPDARYSALLQEDFAYSGFECWVENEDQIQEPHSCHGSEGPGNRPRRCRGCAALRVADSDYEAICKVPRKVARSISCGPSSRWSTSICTEEPALSEVGPPDLASTKVPPDGESMEEETPGSSVESLDASVQASPPQQKDEETERSAKELGKCDCCSDDQAPQHGCNHKLELALSMIKGLDYKPIQSPRGSRLPIPVKSSLPGAKPGPSMTDGVSSGFLNRSLKPLYKTPVSYPLELSDLQELWDDLCEDYLPLRVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGCLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQ

SEQ ID NO: 57735 - protein, 2346 aa, Homo sapiens
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGCLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPWKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEVKSLRALPCTPAL

SEQ ID NO: 57736 - protein, 2362 aa, Homo sapiens
MSNGYRTLSQHLNDLKKENFSLKLRIYFLEERMQQKYEASREDIYKRNIELKVEVESLKRELQDKKQHLDKTWADVENLNSQNEAELRRQFEERQQETEHVYELLENKIQLLQEESRLAKNEAARMAALVEAEKECNLELSEKLKGVTKNWEDVPGDQVKPDQYTEALAQRDKRIEELNQSLAAQERLVEQLSREKQQLLHLLEEPTSMEVQPMTEELLKQQKLNSHETTITQQSVSDSHLAELQEKIQQTEATNKILQEKLNEMSYELKCAQESSQKQDGTIQNLKETLKSRERETEELYQVIEGQNDTMAKLREMLHQSQLGQLHSSEGTSPAQQQVALLDLQSALFCSQLEIQKLQRVVRQKERQLADAKQCVQFVEAAAHESEQQKEASWKHNQELRKALQQLQEELQNKSQQLRAWEAEKYNEIRTQEQNIQHLNHSLSHKEQLLQEFRELLQYRDNSDKTLEANEMLLEKLRQRIHDKAVALERAIDEKFSALEEKEKELRQLRLAVRERDHDLERLRDVLSSNEATMQSMESLLRAKGLEVEQLSTTCQNLQWLKEEMETKFSRWQKEQESIIQQLQTSLHDRNKEVEDLSATLLCKLGPGQSEIAEELCQRLQRKERMLQDLLSDRNKQVLEHEMEIQGLLQSVSTREQESQAAAEKLVQALMERNSELQALRQYLGGRDSLMSQAPISNQQAEVTPTGCLGKQTDQGSMQIPSRDDSTSLTAKEDVSIPRSTLGDLDTVAGLEKELSNAKEELELMAKKERESQMELSALQSMMAVQEEELQVQAADMESLTRNIQIKEDLIKDLQMQLVDPEDIPAMERLTQEVLLLREKVASVESQGQEISGNRRQQLLLMLEGLVDERSRLNEALQAERQLYSSLVKFHAHPESSERDRTLQVELEGAQVLRSRLEEVLGRSLERLNRLETLAAIGGAAAGDDTEDTSTEFTDSIEEEAAHHSHQQLVKVALEKSLATVETQNPSFSPPSPMGGDSNRCLQEEMLHLRAEFHQHLEEKRKAEEELKELKAQIEEAGFSSVSHIRNTMLSLCLENAELKEQMGEAMSDGWEIEEDKEKGEVMVETVVTKEGLSESSLQAEFRKLQGKLKNAHNIINLLKEQLVLSSKEGNSKLTPELLVHLTSTIERINTELVGSPGKHQHQEEGNVTVRPFPRPQSLDLGATFTVDAHQLDNQSQPRDPGPQSAFSLPGSTQHLRSQLSQCKQRYQDLQEKLLLSEATVFAQANELEKYRVMLTGESLVKQDSKQIQVDLQDLGYETCGRSENEAEREETTSPECEEHNSLKEMVLMEGLCSEQGRRGSTLASSSERKPLENQLGKQEEFRVYGKSENILVLRKDIKDLKAQLQNANKVIQNLKSRVRSLSVTSDYSSSLERPWKLRAVGTLEGSSPHSVPDEDEGWLSDGTGAFYSPGLQAKKDLESLIQRVSQLEAQLPKNGLEEKLAEELRSASWPGKYDSLIQDQARELSYLRQKIREGRGICYLITRHAKDTVKSFEDLLRSNDIDYYLGQSFREQLAQGSQLTERLTSKLSTKDHKSEKDQAGLEPLALRLSRELQEKEKVIEVLQAKLDARSLTPSSSHALSDSHRSPSSTSFLSDELEACSDMDIVSEYTHYEEKKASPSHSDSIHHSSHSAVLSSKPSSTSASQGAKAESNSNPISLPTPQNTPKEANQAHSGFHFHSIPKLASLPQAPLPSAPSSFLPFSPTGPLLLGCCETPVVSLAEAQQELQMLQKQLGESASTVPPASTATLLSNDLEADSSYYLNSAQPHSPPRGTIELGRILEPGYLGSSGKWDVMRPQKGSVSGDLSSGSSVYQLNSKPTGADLLEEHLGEIRNLRQRLEESICINDRLREQLEHRLTSTARGRGSTSNFYSQGLESIPQLCNENRVLREDNRRLQAQLSHVSREHSQETESLREALLSSRSHLQELEKELEHQKVERQQLLEDLREKQQEVLHFREERLSLQENDSRLQHKLVLLQQQCEEKQQLFESLQSELQIYEALYGNSKKGLKAYSLDACHQIPLSSDLSHLVAEVRALRGQLEQSIQGNNCLRLQLQQQLESGAGKASLSPSSINQNFPASTDPGNKQLLLQDSAVSPPVRDVGMNSPALVFPSSASSTPGSETPIINRANGLGLDTSPVMKTPPKLEGDATDGSFANKHGRHVIGHIDDYSALRQQIAEGKLLVKKIVSLVRSACSFPGLEAQGTEVLGSKGIHELRSSTSALHHALEESASLLTMFWRAALPSTHIPVLPGKVGESTERELLELRTKVSKQERLLQSTTEHLKNANQQKESMEQFIVSQLTRTHDVLKKARTNLEEPCKKRSHQKSLKQQERWACPPFVQLPIC

SEQ ID NO: 57737 - protein, 518 aa, Homo sapiens
MPEANYLLSVSWGYIKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 57738 - protein, 809 aa, Homo sapiens
MEAEGSSAPARAGSGEGSDSAGGATLKAPKHLWRHEQHHQYPLRQPQFRLLHPHHHLPPPPPPSPQPQPQCPLQPPPPPPLPPPPPPPGAARGRYASSGATGRVRHRGYSDTERYLYCRAMDRTSYAVETGHRPGLKKSRMSWPSSFQGLRRFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 57739 - protein, 678 aa, Homo sapiens [sequence omitted]

SEQ ID NO: 57740 - protein, 507 aa, Homo sapiens
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 57741 - protein, 673 aa, Homo sapiens
MMHVNNFPFRRHSWICFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 57742 - protein, 687 aa, Homo sapiens
MAFVWDPLGATVPGPSTRAKSRLRFSKSYSFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 57743 - protein, 748 aa, Homo sapiens
MKRNTCDLLSRSKSASEETLHSSNEEEDPFRGMEPYLVRRLSCRNIQLPPLAFRQLEQADLKSESENIQRPTSLPLKILPLIAITSAESSGFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 57744 - protein, 219 aa, Homo sapiens
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITGSWMELNPYTLLDM

SEQ ID NO: 57745 - protein, 679 aa, Homo sapiens
MSIIMKPRSRSTSSLRTAEAVCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 57746 - protein, 422 aa, Homo sapiens
MASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPE

SEQ ID NO: 57747 - protein, 81 aa, Homo sapiens
MKRNTCDLLSRSKSASEETLHSSNEEEDPFRGMEPYLVRRLSCRNIQLPPLAFRQLEQADLKSESENIQRPTSLPLKILPL

SEQ ID NO: 57748 - protein, 745 aa, Homo sapiens
MAQQTSPDTLTVPEVDNPHCPNPWLNEDLVKSLRENLLQHEKSKTARKSVSPKLSPVISPRNSPRLLRRMLLSSNIPKQRRFTVAHTCFDVDNGTSAGRSPLDPMTSPGSGLILQANFVHSQRRESFLYRSDSDYDLSPKSMSRNSSIASDIHGDDLIVTPFAQVLASLRTVRNNFAALTNLQDRAPSKRSPMCNQPSINKATITEEAYQKLASETLEELDWCLDQLETLQTRHSVSEMASNKFKRMLNRELTHLSEMSRSGNQVSEFISNTFLDKQHEVEIPSPTQKEKEKKKRPMSQISGVKKLMHSSSLTNSSIPRFGVKTEQEDVLAKELEDVNKWGLHVFRIAELSGNRPLTVIMHTIFQERDLLKTFKIPVDTLITYLMTLEDHYHADVAYHNNIHAADVVQSTHVLLSTPALEAVFTDLEILAAIFASAIHDVDHPGVSNQFLINTNSELALMYNDSSVLENHHLAVGFKLLQEENCDIFQNLTKKQRQSLRKMVIDIVLATDMSKHMNLLADLKTMVETKKVTSSGVLLLDNYSDRIQVLQNMVHCADLSNPTKPLQLYRQWTDRIMEEFFRQGDRERERGMEISPMCDKHNASVEKSQVGFIDYIVHPLWETWADLVHPDAQDILDTLEDNREWYQSTIPQSPSPAPDDPEEGRQGQTEKFQFELTLEEDGESDTEKDSGSQVEEDTSCSDSKTLCTQDSESTEIPLDEQVEEEAVGEEEESQPEACVIDDRSPDT

SEQ ID NO: 57749 - protein, 75 aa, Homo sapiens
MKRNTCDLLSRSKSASEETLHSSNEEEDPFRGMEPYLVRRLSCRNIQLPPLAFRQLEQADLKSESENIQRPTSLP

SEQ ID NO: 57750 - protein, 748 aa, Homo sapiens; identical to SEQ ID NO: 57743

SEQ ID NO: 57751 - protein, 833 aa, Homo sapiens
MLPFGDKTREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 57752 - protein, 875 aa, Homo sapiens
MERAGPSFGQQRQQQQPQQQKQQQRDQDSVEAWLDDHWDFTFSYFVRKATREMVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 57753 - protein, 823 aa, Homo sapiens
MVNAWFAERVHTIPVCKEGIRGHTESCSCPLQQSPRADNSAPGTPTRKISASEFDRPLRPIVVKDSEGTVSFLSDSEKKEQMPLTPPRFDHDEGDQCSRLLELVKDISSHLDVTALCHKIFLHIHGLISADRYSLFLVCEDSSNDKFLISRLFDVAEGSTLEEVSNNCIRLEWNKGIVGHVAALGEPLNIKDAYEDPRFNAEVDQITGYKTQSILCMPIKNHREEVVGVAQAINKKSGNGGTFTEKDEKDFAAYLAFCGIVLHNAQLYETSLLENKRNQVLLDLASLIFEEQQSLEVILKKIAATIISFMQVQKCTIFIVDEDCSDSFSSVFHMECEELEKSSDTLTREHDANKINYMYAQYVKNTMEPLNIPDVSKDKRFPWTTENTGNVNQQCIRSLLCTPIKNGKKNKVIGVCQLVNKMEENTGKVKPFNRNDEQFLEAFVIFCGLGIQNTQMYEAVERAMAKQMVTLEVLSYHASAAEEETRELQSLAAAVVPSAQTLKITDFSFSDFELSDLETALCTIRMFTDLNLVQNFQMKHEVLCRWILSVKKNYRKNVAYHNWRHAFNTAQCMFAALKAGKIQNKLTDLEILALLIAALSHDLDHRGVNNSYIQRSEHPLAQLYCHSIMEHHHFDQCLMILNSPGNQILSGLSIEEYKTTLKIIKQAILATDLALYIKRRGEFFELIRKNQFNLEDPHQKELFLAMLMTACDLSAITKPWPIQQRIAELVATEFFDQGDRERKELNIEPTDLMNREKKNKIPSMQVGFIDAICLQLYEALTHVSEDCFPLLDGCRKNRQKWQALAEQQEKMLINGESGQAKRN

SEQ ID NO: 57754 - protein, 860 aa, Homo sapiens
MGEVTAEEVEKFLDSNIGFAKQYYNLHYRAKLISDLLGAKEAAVDFSNYHSPSSMEESEIIFDLLRDFQENLQTEKCIFNVMKKLCFLLQADRMSLFMYRTRNGIAELATRLFNVHKDAVLEDCLVMPDQEIVFPLDMGIVGHVAHSKKIANVPNTEEDEHFCDFVDILTEYKTKNILASPIMNGKDVVAIIMAVNKVDGSHFTKRDEEILLKYLNFANLIMKVYHLSYLHNCETRRGQILLWSGSKVFEELTDIERQFHKALYTVRAFLNCDRYSVGLLDMTKQKEFFDVWPVLMGEVPPYSGPRTPDGREINFYKVIDYILHGKEDIKVIPNPPPDHWALVSGLPAYVAQNGLICNIMNAPAEDFFAFQKEPLDESGWMIKNVLSMPIVNKKEEIVGVATFYNRKDGKPFDEMDETLMESLTQFLGWSVLNPDTYESMNKLENRKDIFQDIVKYHVKCDNEEIQKILKTREVYGKEPWECEEEELAEILQAELPDADKYEINKFHFSDLPLTELELVKCGIQMYYELKVVDKFHIPQEALVRFMYSLSKGYRKITYHNWRHGFNVGQTMFSLLVTGKLKRYFTDLEALAMVTAAFCHDIDHRGTNNLYQMKSQNPLAKLHGSSILERHHLEFGKTLLRDESLNIFQNLNRRQHEHAIHMMDIAIIATDLALYFKKRTMFQKIVDQSKTYESEQEWTQYMMLEQTRKEIVMAMMMTACDLSAITKPWEVQSQVALLVAAEFWEQGDLERTVLQQNPIPMMDRNKADELPKLQVGFIDFVCTFVYKEFSRFHEEITPMLDGITNNRKEWKALADEYDAKMKVQEEKKQKQQSAKSAAAGNQPGGNPSPGGATTSKSCCIQ

SEQ ID NO: 57755 - protein, 575 aa, Homo sapiens
MTKEKEFFDVWSVLMGESQPYSGPRTPDGREIVFYKVIDYVLHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 57756 - protein, 853 aa, Homo sapiens
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYVLHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKGTEICNGGPAPKSSTCCIL

SEQ ID NO: 57757 - protein, 854 aa, Homo sapiens
MSLSEEQARSFLDQNPDFARQYFGKKLSPENVAAACEDGCPPDCDSLRDLCQVEESTALLELVQDMQESINMERVVFKVLRRLCTLLQADRCSLFMYRQRNGVAELATRLFSVQPDSVLEDCLVPPDSEIVFPLDIGVVGHVAQTKKMVNVEDVAECPHFSSFADELTDYKTKNMLATPIMNGKDVVAVIMAVNKLNGPFFTSEDEDVFLKYLNFATLYLKIYHLSYLHNCETRRGQVLLWSANKVFEELTDIERQFHKAFYTVRAYLNCERYSVGLLDMTKEKEFFDVWSVLMGESQPYSGPRTPDGREIVFYKVIDYVLHGKEEIKVIPTPSADHWALASGLPSYVAESGFICNIMNASADEMFKFQEGALDDSGWLIKNVLSMPIVNKKEEIVGVATFYNRKDGKPFDEQDEVLMESLTQFLGWSVMNTDTYDKMNKLENRKDIAQDMVLYHVKCDRDEIQLILPTRARLGKEPADCDEDELGEILKEELPGPTTFDIYEFHFSDLECTELDLVKCGIQMYYELGVVRKFQIPQEVLVRFLFSISKGYRRITYHNWRHGFNVAQTMFTLLMTGKLKSYYTDLEAFAMVTAGLCHDIDHRGTNNLYQMKSQNPLAKLHGSSILERHHLEFGKFLLSEETLNIYQNLNRRQHEHVIHLMDIAIIATDLALYFKKRAMFQKIVDESKNYQDKKSWVEYLSLETTRKEIVMAMMMTACDLSAITKPWEVQSKVALLVAAEFWEQGDLERTVLDQQPIPMMDRNKAAELPKLQVGFIDFVCTFVYKEFSRFHEEILPMFDRLQNNRKEWKALADEYEAKVKALEEKEEEERVAAKKVGTEICNGGPAPKSSTCCIL

SEQ ID NO: 57758 - protein, 858 aa, Homo sapiens
MGEINQVAVEKYLEENPQFAKEYFDRKLRVEVLGEIFKNSQVPVQSSMSFSELTQVEESALCLELLWTVQEEGGTPEQGVHRALQRLAHLLQADRCSMFLCRSRNGIPEVASRLLDVTPTSKFEDNLVGPDKEVVFPLDIGIVGWAAHTKKTHNVPDVKKNSHFSDFMDKQTGYVTKNLLATPIVVGKEVLAVIMAVNKVNASEFSKQDEEVFSKYLNFVSIILRLHHTSYMYNIESRRSQILMWSANKVFEELTDVERQFHKALYTVRSYLNCERYSIGLLDMTKEKEFYDEWPIKLGEVEPYKGPKTPDGREVNFYKIIDYILHGKEEIKVIPTPPADHWTLISGLPTYVAENGFICNMMNAPADEYFTFQKGPVDETGWVIKNVLSLPIVNKKEDIVGVATFYNRKDGKPFDEHDEYITETLTQFLGWSLLNTDTYDKMNKLENRKDIAQEMLMNQTKATPEEIKSILKFQEKLNVDVIDDCEEKQLVAILKEDLPDPRSAELYEFRFSDFPLTEHGLIKCGIRLFFEINVVEKFKVPVEVLTRWMYTVRKGYRAVTYHNWRHGFNVGQTMFTLLMTGRLKKYYTDLEAFAMLAAAFCHDIDHRGTNNLYQMKSTSPLARLHGSSILERHHLEYSKTLLQDESLNIFQNLNKRQFETVIHLFEVAIIATDLALYFKKRTMFQKIVDACEQMQTEEEAIKYVTVDPTKKEIIMAMMMTACDLSAITKPWEVQSQVALMVANEFWEQGDLERTVLQQQPIPMMDRNKRDELPKLQVGFIDFVCTFVYKEFSRFHKEITPMLSGLQNNRVEWKSLADEYDAKMKVIEEEAKKQEGGAEKAAEDSGGGDDKKSKTCLML

SEQ ID NO: 57759 - protein, 150 aa, Homo sapiens
MSAKDERAREILRGFKLNWMNLRDAETGKILWQGTEDLSVPGVEHEARVPKKILKCKAVSRELNFSSTEQMEKFRLEQKVYFKGQCLEEWFFEFGFVIPNSTNTWQSLIEAAPESQMMPASVLTGNVIIETKFFDDDLLVSTSRVRLFYV

SEQ ID NO: 57760 - protein, 137 aa, Homo sapiens
MKQRDKGRGWHPAEGGPALTAQPPETRPALDRSRRESRSQGCRGVSVSLTMNLEPPKAEFRSATRVAGGPVTPRKGPPKFKQRQTRQFKSKPPKKGVQGFGDDIPGMEGLGTDITVICPWEAFNHLELHELAQYGII

SEQ ID NO: 57761 - protein, 87 aa, Homo sapiens
MNLEPPKAEFRSATRVAGGPVTPRKGPPKFKQRQTRQFKSKPPKKGVQGFGDDIPGMEGLGTDITVICPWEAFNHLELHELAQYGII

SEQ ID NO: 57762 - protein, 83 aa, Homo sapiens
MSDNTTLPAPASNQGPTTPRKGPPKFKQRQTRQFKSKPPKKGVKGFGDDIPGMEGLGTDITVICPWEAFSHLELHELAQFGII

SEQ ID NO: 57763 - protein, 456 aa, Homo sapiens
MGITLIWCLALVLIKWITSKRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 57764 - protein, 424 aa, Homo sapiens
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGNYTYLDIAG

SEQ ID NO: 57765 - protein, 482 aa, Homo sapiens
MEVCYQLPVLPLDRPVPQHVLSRRGAISFSSSSALFGCPNPRQLSQRRGAISYDSSDQTALYIRMLGDVRVRSRAGFESERRGSHPYIDFRIFHSQSEIEVSVSARNIRRLLSFQRYLRSSRFFRGTAVSNSLNILDDDYNGQAKCMLEKVGNWNFDIFLFDRLTNGNSLVSLTFHLFSLHGLIEYFHLDMMKLRRFLVMIQEDYHSQNPYHNAVHAADVTQAMHCYLKEPKLANSVTPWDILLSLIAAATHDLDHPGVNQPFLIKTNHYLATLYKNTSVLENHHWRSAVGLLRESGLFSHLPLESRQQMETQIGALILATDISRQNEYLSLFRSHLDRGDLCLEDTRHRHLVLQMALKCADICNPCRTWELSKQWSEKVTEEFFHQGDIEKKYHLGVSPLCDRHTESIANIQIGFMTYLVEPLFTEWARFSNTRLSQTMLGHVGLNKASWKGLQREQSSSEDTDAAFELNSQLLPQENRLS

SEQ ID NO: 57766 - protein, 829 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 57767 - protein, 783 aa, Homo sapiens
MGCAPSIHISERLVAEDAPSPAAPPLSSGGPRLPQGQKTAALPRTRGAGLLESELRDGSGKKVAVADVQFGPMRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 57768 - protein, 829 aa, Homo sapiens; identical to SEQ ID NO: 57766

SEQ ID NO: 57769 - protein, 757 aa, Homo sapiens
MRFHQDQLQVLLVFTKEDNQCNGFCRACEKAGFKCTVTKEAQAVLACFLDKHHDIIIIDHRNPRQLDAEALCRSIRSSKLSENTVIVGVVRRVDREELSVMPFISAGFTRRYVENPNIMACYNELLQLEFGEVRSQLKLRACNSVFTALENSEDAIEITSEDRFIQYANPAFETTMGYQSGELIGKELGEVPINEKKADLLDTINSCIRIGKEWQGIYYAKKKNGDNIQQNVKIIPVIGQGGKIRHYVSIIRVCNGNNKAEKISECVQSDTHTDNQTGKHKDRRKGSLDVKAVASRATEVSSQRRHSSMARIHSMTIEAPITKVINIINAAQESSPMPVTEALDRVLEILRTTELYSPQFGAKDDDPHANDLVGGLMSDGLRRLSGNEYVLSTKNTQMVSSNIITPISLDDVPPRIARAMENEEYWDFDIFELEAATHNRPLIYLGLKMFARFGICEFLHCSESTLRSWLQIIEANYHSSNPYHNSTHSADVLHATAYFLSKERIKETLDPIDEVAALIAATIHDVDHPGRTNSFLCNAGSELAILYNDTAVLESHHAALAFQLTTGDDKCNIFKNMERNDYRTLRQGIIDMVLATEMTKHFEHVNKFVNSINKPLATLEENGETDKNQEVINTMLRTPENRTLIKRMLIKCADVSNPCRPLQYCIEWAARISEEYFSQTDEEKQQGLPVVMPVFDRNTCSIPKSQISFIDYFITDMFDAWDAFVDLPDLMQHLDNNFKYWKGLDEMKLRNLRPPPE

SEQ ID NO: 57770 - protein, 885 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 57771 - protein, 830 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 57772 - protein, 838 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 57773 - protein, 865 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQYVNPAFERMMGYHKGELLGKELADLPKSDKNRADLLDTINTCIKKGKEWQGVYYARRKSGDSIQQHVKITPVIGQGGKIRHFVSLKKLCCTTDNNKQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 57774 - protein, 788 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIEHGEVRSQFKLRACNSVFTALDHCHEAIEITSDDHVIQIHKIHRDSGDNSQTEPHSFRYKNRRKESIDVKSISSRGSDAPSLQNRRYPSMARIHSMTIEAPITKVINIINAAQENSPVTVAEALDRVLEILRTTELYSPQLGTKDEDPHTSDLVGGLMTDGLRRLSGNEYVFTKNVHQSHSHLAMPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 57775 - protein, 350 aa, Homo sapiens
MPITINDVPPCISQLLDNEESWDFNIFELEAITHKRPLVYLGLKVFSRFGVCEFLNCSETTLRAWFQVIEANYHSSNAYHNSTHAADVLHATAFFLGKERVKGSLDQLDEVAALIAATVHDVDHPGRTNSFLCNAGSELAVLYNDTAVLESHHTALAFQLTVKDTKCNIFKNIDRNHYRTLRQAIIDMVLATEMTKHFEHVNKFVNSINKPMAAEIEGSDCECNPAGKNFPENQILIKRMMIKCADVANPCRPLDLCIEWAGRISEEYFAQTDEEKRQGLPVVMPVFDRNTCSIPKSQISFIDYFITDMFDAWDAFAHLPALMQHLADNYKHWKTLDDLKCKSLRLPSDS

SEQ ID NO: 57776 - protein, 593 aa, Homo sapiens
MGSGSSSYRPKAIYLDIDGRIQKVIFSKYCNSSDIMDLFCIATGLPRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57777 - protein, 567 aa, Homo sapiens
MGSGSSSYRPKAIYLDIDGRIQKVIFSKYCNSSDIMDLFCIATGLPRTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57778 - protein, 491 aa, Homo sapiens
MGSGSSSYRPKAIYLDIDGRIQKEHDHLPADHRRRHGLHRPHHAREFRTHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57779 - protein, 533 aa, Homo sapiens
MGSGSSSYRPKAIYLDIDGRIQKVIFSKYCNSSDIMDLFCIATGLPRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57780 - protein, 465 aa, Homo sapiens
MGSGSSSYRPKAIYLDIDGRIQKHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57781 - protein, 540 aa, Homo sapiens
MGSGSSSYRPKAIYLDIDGRIQKVIFSKYCNSSDIMDLFCIATGLPRNTTISLLTTDDAMVSIDPTMPANSERNELILYTSLRNLLFLPSKESWASHQHSVQSETCGHQATLRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57782 - protein, 466 aa, Homo sapiens
MDAFRSTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57783 - protein, 552 aa, Homo sapiens
MDAFRRNTTISLLTTDDAMVSIDPTMPANSERTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57784 - protein, 433 aa, Homo sapiens
MDAFRRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57785 - protein, 459 aa, Homo sapiens
MDAFRRNTTISLLTTDDAMVSIDPTMPANSERAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57786 - protein, 526 aa, Homo sapiens
MDAFRSTPYKVRPVAIKQLSAGVEDKRTTSRGQSAERPLRDRRVVGLEQPRREGAFESGQVEPRPREPQGCYQEGQRIPPEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57787 - protein, 492 aa, Homo sapiens
MDAFRRNTTISLLTTDDAMVSIDPTMPANSERTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57788 - protein, 507 aa, Homo sapiens
MGSGSSSYRPKAIYLDIDGRIQKVIFSKYCNSSDIMDLFCIATGLPRTPYKVRPVAIKQLSEREELIQSVLAQVAEQFSRAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57789 - protein, 465 aa, Homo sapiens
MDLFCIATGLPRNTTISLLTTDDAMVSIDPTMPANSERAFKINELKAEVANHLAVLEKRVELEGLKVVEIEKCKSDIKKMREELAARSSRTNCPCKYSFLDNHKKLTPRRDVPTYPKYLLSPETIEALRKPTFDVWLWEPNEMLSCLEHMYHDLGLVRDFSINPVTLRRWLFCVHDNYRNNPFHNFRHCFCVAQMMYSMVWLCSLQEKFSQTDILILMTAAICHDLDHPGYNNTYQINARTELAVRYNDISPLENHHCAVAFQILAEPECNIFSNIPPDGFKQIRQGMITLILATDMARHAEIMDSFKEKMENFDYSNEEHMTLLKMILIKCCDISNEVRPMEVAEPWVDCLLEEYFMQSDREKSEGLPVAPFMDRDKVTKATAQIGFIKFVLIPMFETVTKLFPMVEEIMLQPLWESRDRYEELKRIDDAMKELQKKTDSLTSGATEKSRERSRDVKNSEGDCA

SEQ ID NO: 57790 - protein, 622 aa, Homo sapiens
MPPQLQNGLNLSAKVVQGSLDSLPQAVREFLENNAELCQPDHIHICDGSEEENGRLLGQMEEEGILRRLKKYDNCWLALTDPRDVARIESKTVIVTQEQRDTVPIPKTGLSQLGRWMSEEDFEKAFNARFPGCMKGRTMYVIPFSMGPLGSPLSKIGIELTDSPYVVASMRIMTRMGTPVLEAVGDGEFVKCLHSVGCPLPLQKPLVNNWPCNPELTLIAHLPDRREIISFGSGYGGNSLLGKKCFALRMASRLAKEEGWLAEHMLILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 57791 - protein, 313 aa, Homo sapiens
MTTGRTMYVIPFSMGPLGSPLSKIGIELTDSPYVVASMRIMTRMGTPVLEAVGDGEFVKCLHSVGCPLPLQKPLVNNWPCNPELTLIAHLPDRREIISFGSGYGGNSLLGKKCFALRMASRLAKEEGWLAEHMLILGITNPEGEKKYLAAAFPSACGKTNLAMMNPSLPGWKVECVGDDIAWMKFDAQGHLRAINPENGFFGVAPGTSVKTNPNAIKTIQKNTIFTNVAETSDGGVYWEGIDEPLASGVTITSWKNKEWSSEDGVSLPEALVCRAAGTACLSQALTSLSLSYRGTLCPPQLEVLHPCQPVPHH

SEQ ID NO: 57792 - protein, 304 aa, Homo sapiens
TTGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 57793 - protein, 305 aa, Homo sapiens
MTTGHLRAINPENGFFGVAPGTSVKTNPNAIKTIQKNTIFTNVAETSDGGVYWEGIDEPLASGVTITSWKNKEWSSEDGEPCAHPNSRFCTPASQCPIIDAAWESPEGVPIEGIIFGGRRPAGVPLVYEALSWQHGVFVGAAMRSEATAAAEHKGKIIMHDPFAMRPFFGYNFGKYLAHWLSMAQHPAAKLPKIFHVNWFRKDKEGKFLWPGFGENSRVLEWMFNRIDGKASTKLTPIGYIPKEDALNLKGLGHINMMELFSISKEFWEKEVEDIEKYLEDQVNADLPCEIEREILALKQRISQM

SEQ ID NO: 57794 - protein, 640 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVQLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 57795 - protein, 441 aa, Homo sapiens
MAALYRPGLRLNWHGLSPLGWPSCRSIQTLRVLSGDLGQLPTGIRDFVEHSARLCQPEGIHICDGTEAENTATLTLLEQQGLIRKLPKYNNCWLARTDPKDVARVESKTVIVTPSQRDTVQLPPGGARGQLGNWMSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGMCGGEGVAQPPGLSTLMVEKLSPQPPTIF

SEQ ID NO: 57796 - protein, 506 aa, Homo sapiens
MSPADFQRAVDERFPGCMQGRTMYVLPFSMGPVGSPLSRIGVQLTDSAYVVASMRIMTRLGTPVLQALGDGDFVKCLHSVGQPLTGQGEPVSQWPCNPEKTLIGHVPDQREIISFGSGYGGNSLLGKKCFALRIASRLARDEGWLAEHMLILGITSPAGKKRYVAAAFPSACGKTNLAMMRPALPGWKVECVGDDIAWMRFDSEGRLRAINPENGFFGVAPGTSATTNPNAMATIQSNTIFTNVAETSDGGVYWEGIDQPLPPGVTVTSWLGKPWKPGDKEPCAHPNSRFCAPARQCPIMDPAWEAPEGVPIDAIIFGGRRPKGVPLVYEAFNWRHGVFVGSAMRSESTAAAEHKGKIIMHDPFAMRPFFGYNFGHYLEHWLSMEGRKGAQLPRIFHVNWFRRDEAGHFLWPGFGENARVLDWICRRLEGEDSARETPIGLVPKEGALDLSGLRAIDTTQLFSLPKDFWEQEVRDIRSYLTEQVNQDLPKEVLAELEALERRVHKM

SEQ ID NO: 57797 - protein, 506 aa, Homo sapiens; identical to SEQ ID NO: 57796

SEQ ID NO: 57798 - protein, 780 aa, Homo sapiens
MAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 57799 - protein, 253 aa, Homo sapiens
MRSMCNQGRGRESSRGGLHVQGSCRGLSRSPQQETGFAKAPAGTDCFFHCSPGSRGQGDRKEEVTSEPGGTSIMSRLGGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTRGRLGELHV

SEQ ID NO: 57800 - protein, 827 aa, Homo sapiens
MCNQGRGRESSRGGLHVQGSCRGLSRSPQQETGFAKAPAGTDCFFHCSPGSRGQGDRKEEVTSEPGGTSIMSRLGGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 57801 - protein, 573 aa, Homo sapiens
MGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 57802 - protein, 780 aa, Homo sapiens
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 57803 - protein, 851 aa, Homo sapiens
MHKDEFHLKFFMCVIQSRQLVRTPQRTAGEASTSSMLIPKPPPKTDILKSLDTMDDPDTVGSIPVFKTEWIMTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNLVVKRLGYDTRVTVLGHVQRGGTPSAFDRILGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 57804 - protein, 780 aa, Homo sapiens; identical to SEQ ID NO: 57802

SEQ ID NO: 57805 - protein, 749 aa, Homo sapiens
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGLVGSIDNDFCGTDMTIGTDSALHRIMEIVDAITTTAQSHQRTFVLEVMGRHCGYLALVTSLSCGADWVFIPECPPDDDWEEHLCRRLSETRTRGSRLNIIIVAEGAIDKNGKPITSEDIKNGSRMGVEAVMALLEGTPDTPACVVSLSGNQAVRLPLMECVQVTKDVTKAMDEKKFDEALKLRGRSFMNNWEVYKLLAHVRPPVSKSGSHTVAVMNVGAPAAGMNAAVRSTVRIGLIQGNRVLVVHDGFEGLAKGQIEEAGWSYVGGWTGQGGSKLGTKRTLPKKSFEQISANITKFNIQGLVIIGGFEAYTGGLELMEGRKQFDELCIPFVVIPATVSNNVPGSDFSVGADTALNTICTTCDRIKQSAAGTKRRVFIIETMGGYCGYLATMAGLAAGADAAYIFEEPFTIRDLQANVEHLVQKMKTTVKRGLVLRNEKCNENYTTDFIFNLYSEEGKGIFDSRKNVLGHMQQGGSPTPFDRNFATKMGAKAMNWMSGKIKESYRNGRIFANTPDSGCVLGMRKRALVFQPVAELKDQTDFEHRIPKEQWWLKLRPILKILAKYEIDLDTSDHAHLEHITRKRSGEAAV

SEQ ID NO: 57806 - protein, 177 aa, Homo sapiens [sequence omitted]

SEQ ID NO: 57807 - protein, 780 aa, Homo sapiens; identical to SEQ ID NO: 57802

SEQ ID NO: 57808 - protein, 117 aa, Homo sapiens
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIG

SEQ ID NO: 57809 - protein, 161 aa, Homo sapiens
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLNIVGL

SEQ ID NO: 57810 - protein, 157 aa, Homo sapiens
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDLQKAGKITDEEATKSSYLN

SEQ ID NO: 57811 - protein, 85 aa, Homo sapiens
MTHEEHHAAKTLGIGKAIAVLTSGGDAQGMNAAVRAVVRVGIFTGARVFFVHEGYQGLVDGGDHIKEATWESVSMMLQLGGTVIG

SEQ ID NO: 57812 - protein, 139 aa, Homo sapiens
MTHEEHHAAKTLGIGKAIAVLTSGGDAQGMNAAVRAVVRVGIFTGARVFFVHEGYQGLVDGGDHIKEATWESVSMMLQLGGTVIGSARCKDFREREGRLRAAYNLVKRGITNLCVIGGDGSLTGADTFRSEWSDLLSDL

SEQ ID NO: 57813 - protein, 749 aa, Homo sapiens; identical to SEQ ID NO: 57805

SEQ ID NO: 57814 - protein, 202 aa, Homo sapiens
MGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 57815 - protein, 776 aa, Homo sapiens
MCGYERCRPCRGAHGYLRGGQGVLHLRGLPGHGGRRLKHRRGRLGECLQHPASGAVRGDWREKPGCWSHRFPCPGRHALVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 57816 - protein, 784 aa, Homo sapiens
MDADDSRAPKGSLRKFLEHLSGAGKAIGVLTSGGDAQGMNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 57817 - protein, 773 aa, Homo sapiens
YERCRPCRGAHGYLRGGQGVLHLRGLPGHGGRRLKHRRGRLGECLQHPASGAVRGDWREKPGCWSHRFPCPGRHALVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKGQIKEIGWTDVGGWTGQGGSILGTKRVLPGKYLEEIATQMRTHSINALLIIGGFEAYLGLLELSAAREKHEEFCVPMVMVPATVSNNVPGSDFSIGADTALNTITDTCDRIKQSASGTKRRVFIIETMGGYCGYLANMGGLAAGADAAYIFEEPFDIRDLQSNVEHLTEKMKTTIQRGLVLRNESCSENYTTDFIYQLYSEEGKGVFDCRKNVLGHMQQGGAPSPFDRNFGTKISARAMEWITAKLKEARGRGKKFTTDDSICVLGISKRNVIFQPVAELKKQTDFEHRIPKEQWWLKLRPLMKILAKYKASYDVSDSGQLEHVQPWSV

SEQ ID NO: 57818 - protein, 210 aa, Homo sapiens
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTTAQSHQRTFVLEVMGRHCGYLALVSALACGADWVFLPESPPEEGW

SEQ ID NO: 57819 - protein, 166 aa, Homo sapiens
  MOD_RES (1)..(1): Any amino acid
XADGHRMLAIYDGFDGFAKGQIKEIGWTDVGGWTGQGGSILGTKRVLPGKYLEEIATQMRTHSINALLIIGGFEAYKSACDMAEARGRHQELCIPLCVVPATISNNVPGTEISLGSDTGLNAVVETCDRIKQSASGTKRRVFIIETMGGYCGYLANMGGLAAGADA

SEQ ID NO: 57820 - protein, 240 aa, Homo sapiens
MGRHCGYLALVSALACGADWVFLPESPPEEGWEEQMCVKLSENRARKKRLNIIIVAEGAIDTQNKPITSEKIKELVVTQLGYDTRVTILGHVQRGGTPSAFDRILASRMGVEAVIALLEATPDTPACVVSLNGNHAVRLPLMECVQMTQDVQKAMDERRFQDAVRLRGRSFAGNLNTYKRLAIKLPDDQIPKTNCNVAVINVGAPAAGMNAAVRSAVRVGIADGHRMLAIYDGFDGFAKG

SEQ ID NO: 57821 - protein, 166 aa, Homo sapiens
MNAAVRAVVRMGIYVGAKVYFIYEGYQGMVDGGSNIAEADWESVSSILQVGGTIIGSARCQAFRTREGRLKAACNLLQRGITNLCVIGGDGSLTGANLFRKEWSGLLEELARNGQIDKEAVQKYAYLNVVGMVGSIDNDFCGTDMTIGTDSALHRIIEVVDAIMTT

SEQ ID NO: 57822 - protein, 103 aa, Homo sapiens
  MOD_RES (1)..(1): Any amino acid
XFIYQLYSEEGKGVFDCRKNVLGHMQQGGAPSPFDRNFGTKISARAMEWITAKLKEARGRGKKFTTDDSICVLGISKRNVIFQPVAELKKQTDFETVSMQPPR

SEQ ID NO: 57823 - protein, 580 aa, Homo sapiens
MSDFEEWISGTYRKMEEGPLPLLTFATAPYHDQKPGTSGLRKKTYYFEEKPCYLENFIQSIFFSIDLKDRQGSSLVVGGDGRYFNKSAIETIVQMAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 57824 - protein, 562 aa, Homo sapiens
MVKIVTVKTQAYQDQKPGTSGLRKRVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 57825 - protein, 538 aa, Homo sapiens
MVKVFQSSANYAENFIQSIISTVEPAQRQEATLVVGGDGRFYMKEAIQLIARIAAANGIGRLVIGQNGILSTPAVSCIIRKIKAIGGIILTASHNPGGPNGDFGIKFNISNGGPAPEAITDKIFQISKTIEEYAVCPDLKVDLGVLGKQQFDLENKFKPFTVEIVDSVEAYATMLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 57826 - protein, 365 aa, Homo sapiens
MLRSIFDFSALKELLSGPNRLKIRIDAMHGVVGPYVKKILCEELGAPANSAVNCVPLEDFGGHHPDPNLTYAADLVETMKSGEHDFGAAFDGDGDRNMILGKHGFFVNPSDSVAVIAANIFSIPYFQQTGVRGFARSMPTSGALDRVASATKIALYETPTGWKFFGNLMDASKLSLCGEESFGTGSDHIREKDGLWAVLAWLSILATRKQSVEDILKDHWQKYGRNFFTRYDYEEVEAEGANKMMKDLEALMFDRSFVGKQFSANDKVYTVEKADNFEYSDPVDGSISRNQGLRLIFTDGSRIVFRLSGTGSAGATIRLYIDSYEKDVAKINQDPQVMLAPLISIALKVSQLQERTGRTAPTVIT

SEQ ID NO: 57827 - protein, 612 aa, Homo sapiens
MAAPEGSGLGEDARLDQETAQWLRWDKNSLTLEAVKRLIAEGNKEELRKCFGARMEFGTAGLRAAMGPGISRMNDLTIIQTTQGFCRYLEKQFSDLKQKGIVISFDARAHPSSGGSSRRFARLAATTFISQGIPVYLFSDITPTPFVPFTVSHLKLCAGIMITASHNPKQDNGYKVYWDNGAQIISPHDKGISQAIEENLEPWPQAWDDSLIDSSPLLHNPSASINNDYFEDLKKYCFHRSVNRETKVKFVHTSVHGVGHSFVQSAFKAFDLVPPEAVPEQKDPDPEFPTVKYPNPEEGKGVLTLSFALADKTKARIVLANDPDADRLAVAEKQDSGEWRVFSGNELGALLGWWLFTSWKEKNQDRSALKDTYMLSSTVSSKILRAIALKEGFHFEETLTGFKWMGNRAKQLIDQGKTVLFAFEEAIGYMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 57828 - protein, 452 aa, Homo sapiens
MITASHNPKQDNGYKVYWDNGAQIISPHDKGISQAIEENLEPWPQAWDDSLIDSSPLLHNPSASINNDYFEDLKKYCFHRSVNRETKVKFVHTSVHGVGHSFVQSAFKAFDLVPPEAVPEQKDPDPEFPTVKYPNPEEGKGVLTLSFALADKTKARIVLANDPDADRLAVAEKQDSGEWRVFSGNELGALLGWWLFTSWKEKNQDRSALKDTYMLSSTVSSKILRAIALKEGFHFEETLTGFKWMGNRAKQLIDQGKTVLFAFEEAIGYMCCPFVLDKDGVSAAVISAELASFLATKNLSLSQQLKAIYVEYGYHITKASYFICHDQETIKKLFENLRNYDGKNNYPKACGKFEISAIRDLTTGYDDSQPDKKAVLPTSKSSQMITFTFANGGVATMRTSGTEPKIKYYAELCAPPGNSDPEQLKKELNELVSAIEEHFFQPQKYNLQPKAD

SEQ ID NO: 57829 - protein, 291 aa, Homo sapiens
MSSQLILRPFTVSHLKLCAGIMITASHNPKQDNGYKVYWDNGAQIISPHDKGISQAIEENLEPWPQAWDDSLIDSSPLLHNPSASINNDYFEDLKKYCFHRSVNRETKVKFVHTSVHGVGHSFVQSAFKAFDLVPPEAVPEQKDPDPEFPTVKYPNPEEGKGVLTLSFALADKTKARIVLANDPDADRLAVAEKQDSGEWRVFSGNELGALLGWWLFTSWKEKNQDRSALKDTYMLSSTVSSKILRAIALKEGFHFEETLTGFKWMGNRAKQLIDQGKTVLFAFEEAIGKK

SEQ ID NO: 57830 - protein, 622 aa, Homo sapiens
MAENTEGDLNSNLLHAPYHTGDPQLDTAIGQWLRWDKNPKTKEQIENLLRNGMNKELRDRLCCRMTFGTAGLRSAMGAGFCYINDLTVIQSTQGMYKYLERCFSDFKQRGFVVGYDTRGQVTSSCSSQRLAKLTAAVLLAKDVPVYLFSRYVPTPFVPYAVQKLKAVAGVMITASHNRKEDNGYKVYWETGAQITSPHDKEILKCIEECVEPWNGSWNDNLVDTSPLKRDPLQDICRRYMEDLKKICFYRELNSKTTLKFVHTSFHGVGHDYVQLAFKVFGFKPPIPVPEQKDPDPDFSTVKCPNPEEGESVLELSLRLAEKENARVVLATDPDADRLAAAELQENGCWKVFTGNELAALFGWWMFDCWKKNKSRNADVKNVYMLATTVSSKILKAIALKEGFHFEETLPGFKWIGSRIIDLLENGKEVLFAFEESIGFLCGTSVLDKDGVSAAVVVAEMASYLETMNITLKQQLVKVYEKYGYHISKTSYFLCYEPPTIKSIFERLRNFDSPKEYPKFCGTFAILHVRDVTTGYDSSQPNKKSVLPVSKNSQMITFTFQNGCVATLRTSGTEPKIKYYAEMCASPDQSDTALLEEELKKLIDALIENFLQPSKNGLIWRSV

SEQ ID NO: 57831 - protein, 570 aa, Homo sapiens
MGGEWGQSAICPESAQEWTYQVGQHLVDMDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 57832 - protein, 147 aa, Homo sapiens
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVL

SEQ ID NO: 57833 - protein, 542 aa, Homo sapiens
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGF

SEQ ID NO: 57834 - protein, 566 aa, Homo sapiens
MDLGAITKYSALHAKPNGLILQYGTAGFRTKAEHLDHVMFRMGLLAVLRSKQTKSTIGVMVTASHNPEEDNGVKLVDPLGEMLAPSWEEHATCLANAEEQDMQRVLIDISEKEAVNLQQDAFVVIGRDTRPSSEKLSQSVIDGVTVLGGQFHDYGLLTTPQLHYMVYCRNTGGRYGKATIEGYYQKLSKAFVELTKQASCSGDEYRSLKVDCANGIGALKLREMEHYFSQGLSVQLFNDGSKGKLNHLCGADFVKSHQKPPQGMEIKSNERCCSFDGDADRIVYYYHDADGHFHLIDGDKIATLISSFLKELLVEIGESLNIGVVQTAYANGSSTRYLEEVMKVPVYCTKTGVKHLHHKAQEFDIGVYFEANGHGTALFSTAVEMKIKQSAEQLEDKKRKAAKMLENIIDLFNQAAGDAISDMLVIEAILALKGLTVQQWDALYTDLPNRQLKVQVADRRVISTTDAERQAVTPPGLQEAINDLVKKYKLSRAFVRPSGTEDVVRVYAEADSQESADHLAHEVSLAVFQLAGGIGERPQPGYKAAETTHNINNAFGPGTANEHTVP

SEQ ID NO: 57835 - protein, 239 aa, Homo sapiens
MEGSPIPVLTVPTAPYEDQRPAGGGGLRRPTGLFEGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGF

SEQ ID NO: 57836 - protein, 567 aa, Homo sapiens
MEGSPIPVLTVPTAPYEDQRPAGGGGLRRPTGLFEGQRNYLPNFIQSVLSSIDLRDRQGCTMVVGSDGRYFSRTAIEIVVQMAAANGIGRLIIGQNGILSTPAVSCIIRKIKAAGGIILTASHCPGGPGGEFGVKFNVANGGPAPDVVSDKIYQISKTIEEYAICPDLRIDLSRLGRQEFDLENKFKPFRVEIVDPVDIYLNLLRTIFDFHAIKGLLTGPSQLKIRIDAMHGVMGPYVRKVLCDELGAPANSAINCVPLEDFGGQHPDPNLTYATTLLEAMKGGEYGFGAAFDADGDRYMILGQNGFFVSPSDSLAIIAANLSCIPYFRQMGVRGFGRSMPTSMALDRVAKSMKVPVYETPAGWRFFSNLMDSGRCNLCGEESFGTGSDHLREKDGLWAVLVWLSIIAARKQSVEEIVRDHWAKFGRHYYCRFDYEGLDPKTTYYIMRDLEALVTDKSFIGQQFAVGSHVYSVAKTDSFEYVDPVDGTVTKKQGLRIIFSDASRLIFRLSSSSGVRATLRLYAESYERDPSGHDQEPQAVLSPLIAIALKISQIHERTGRRGPTVIT

SEQ ID NO: 57837 - protein, 483 aa, Homo sapiens
MAQADIALIGLAVMGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 57838 - protein, 470 aa, Homo sapiens
MGQNLILNMNDHGFVVCAFNRTVSKVDDFLANEAKGTKVVGAQSLKEMVSKLKKPRRIILLVKAGQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 57839 - protein, 461 aa, Homo sapiens
MAQADIALIGLAVMGQNLILNMNDHGFVVCAFNRTVSKVDDFLANEAKGTKVVGAQSLKEMVSKLKKPRRIILLVKAGQAVDDFIEKLRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 57840 - protein, 429 aa, Homo sapiens
MTTALWSVLLIGLSPKLMISWPMRQAVDDFIEKLVPLLDTGDIIIDGGNSEYRDTTRRCRDLKAKGILFVGSGVSGGEEGARYGPSLMPGGNKEAWPHIKTIFQGIAAKVGTGEPCCDWVGDEGAGHFVKMVHNGIEYGDMQLICEAYHLMKDVLGMAQDEMAQAFEDWNKTELDSFLIEITANILKFQDTDGKHLLPKIRDSAGQKGTGKWTAISALEYGVPVTLIGEAVFARCLSSLKDERIQASKKLKGPQKFQFDGDKKSFLEDIRKALYASKIISYAQGFMLLRQAATEFGWTLNYGGIALMWRGGCIIRSVFLGKIKDAFDRNPELQNLLLDDFFKSAVENCQDSWRRAVSTGVQAGIPMPCFTTALSFYDGYRHEMLPASLIQAQRDYFGAHTYELLAKPGQFIHTNWTGHGGTVSSSSYNA

SEQ ID NO: 57841 - protein, 499 aa, Homo sapiens
MTFWTQMFFLLQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSASFGVQQLPLEEIWPLCDFITVHTPLLPSTTGLLNDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 57842 - protein, 533 aa, Homo sapiens
MAFANLRKVLISDSLDPCCRKILQDGGLQVVEKQNLSKEELIAELQDCEGLIVRSATKVTADVINAAEKLQVVGRAGTGVDNVDLEAATRKGILVMNTPNGNSLSAAELTCGMIMCLARQIPQATASMKDGKWERKKFMGTELNGKTLGILGLGRIGREVATRMQSFGMKTIGYDPIISPEVSASFGVQQLPLEEIWPLCDFITVHTPLLPSTTGLLNDNTFAQCKKGVRVVNCARGGIVDEGALLRALQSGQCAGAALDVFTEEPPRDRALVDHENVISCPHLGASTKEAQSRCGEEIAVQFVDMVKGKSLTGVVNAQALTSAFSPHTKPWIGLAEALGTLMRAWAGSPKGTIQVITQGTSLKNAGNCLSPAVIVGLLKEASKQADVNLVNAKLLVKEAGLNVTTSHSPAAPGEQGFGECLLAVALAGAPYQAVGLVQGTTPVLQGLNGAVFRPEVPLRRDLPLLLFRTQTSDPAMLPTMIGLLAEAGVRLLSYQTSLVSDGETWHVMGISSLLPSLEAWKQHVTEAFQFHF

SEQ ID NO: 57843 - protein, 96 aa, Homo sapiens
MKTIGYDPIISPEVSASFGVQQLPLEEIWPLCDFITVHTPLLPSTTGLLNDNTFAQCKKGVRVVNCARGGIVDEGALLRALQSGQCAGAALDVFTE

SEQ ID NO: 57844 - protein, 406 aa, Homo sapiens [sequence omitted]

SEQ ID NO: 57845 - protein, 417 aa, Homo sapiens
MSLSNKLTLDKLDVKGKRVVMRVDFNVPMKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 57846 - protein, 281 aa, Homo sapiens
MSLSNKLTLDKLDVKGKRVVMRVDFNVPMKNNQITNNQRIKAAVPSIKFCLDNGAKSVVLMSHLGRPDGRPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 57847 - protein, 242 aa, Homo sapiens
MVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 57848 - protein, 389 aa, Homo sapiens
MKNNQITNNQRIKAAVPSIKFCLDNGAKSVVLMSHLGRPDGVPMPDKYSLEPVAVELKSLLGKDVLFLKDCVGPEVEKACANPAAGSVILLENLRFHVEEEGKGKDASGNKVKAEPAKIEAFRASLSKLGDVYVNDAFGTAHRAHSSMVGVNLPQKAGGFLMKKELNYFAKALESPERPFLAILGGAKVADKIQLINNMLDKVNEMIIGGGMAFTFLKVLNNMEIGTSLFDEEGAKIVKDLMSKAEKNGVKITLPVDFVTADKFDENAKTGQATVASGIPAGWMGLDCGPESSKKYAEAVTRAKQIVWNGPVGVFEWEAFARGTKALMDEVVKATSRGCITIIGGGDTATCCAKWNTEDKVSHVSTGGGASLELLEGKVLPGVDALSNI

SEQ ID NO: 57849 - protein, 417 aa, Homo sapiens
MSLSKKLTLDKLDVRGKRVIMRVDFNVPMKKNQITNNQRIKASIPSIKYCLDNGAKAVVLMSHLGRPDGVPMPDKYSLAPVAVELKSLLGKDVLFLKDCVGAEVEKACANPAPGSVILLENLRFHVEEEGKGQDPSGKKIKAEPDKIEAFRASLSKLGDVYVNDAFGTAHRAHSSMVGVNLPHKASGFLMKKELDYFAKALENPVRPFLAILGGAKVADKIQLIKNMLDKVNEMIIGGGMAYTFLKVLNNMEIGASLFDEEGAKIVKDIMAKAQKNGVRITFPVDFVTGDKFDENAQVGKATVASGISPGWMGLDCGPESNKNHAQVVAQARLIVWNGPLGVFEWDAFAKGTKALMDEIVKATSKGCITVIGGGDTATCCAKWNTEDKVSHVSTGGGASLELLEGKILPGVEALSNM

SEQ ID NO: 57850 - protein, 254 aa, Homo sapiens
MAAYKLVLIRHGESAWNLENRFSGWYDADLSPAGHEEAKRGGQALRDAGYEFDICFTSVQKRAIRTLWTVLDAIDQMWLPVVRTWRLNERHYGGLTGLNKAETAAKHGEAQVKIWRRSYDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 57851 - protein, 144 aa, Homo sapiens
MPLIRCGCHDVPPPPMEPDHPFYSNISKDRRYADLTEDQLPSCESLKDTIARALPFWNEEIVPQIKEGKRVLIAAHGNSLRGIVKHLEGLSEEAIMELNLPTGIPIVYELDKNLKPIKPMQFLGDEETVRKAMEAVAAQGKAKK

SEQ ID NO: 57852 - protein, 253 aa, Homo sapiens
MATHRLVMVRHGESTWNQENRFCGWFDAELSEKGTEEAKRGAKAIKDAKMEFDICYTSVLKRAIRTLWAILDGTDQMWLPVVRTWRLNERHYGGLTGLNKAETAAKHGEEQVKIWRRSFDIPPPPMDEKHPYYNSISKERRYAGLKPGELPTCESLKDTIARALPFWNEEIVPQIKAGKRVLIAAHGNSLRGIVKHLEGMSDQAIMELNLPTGIPIVYELNKELKPTKPMQFLGDEETVRKAMEAVAAQGKAK

SEQ ID NO: 57853 - protein, 254 aa, Homo sapiens
MAAYKLVLIRHGESTWNLENRFSCWYDADLSPAGHEEAKRGGQALRDAGYEFDICLTSVQKRVIRTLWTVLDAIDQMWLPVVRTWRLNERHYGGLTGLNKAETAAKHGEAQVKIWRRSYDVPPPPMEPDHPFYSNISKDRRYADLTEDQLPSYESPKDTIARALPFWNEEIVPQIKEGKRVLIAAHGNSLQGIAKHVEGLSEEAIMELNLPTGIPIVYELDKNLKPIKPMQFLGDEETVCKAIEAVAAQGKAKK

SEQ ID NO: 57854 - protein, 321 aa, Homo sapiens
MAAAEAGGDDARCVRLSAERAQALLADVDTLLFDCDGVLWRGETAVPGAPEALRALRARGKRLGFITNNSSKTRAAYAEKLRRLGFGGPAGPGASLEVFGTAYCTALYLRQRLAGAPAPKAYVLGSPALAAELEAVGVASVGVGPEPLQGEGPGDWLHAPLEPDVRAVVVGFDPHFSYMKLTKALRYLQQPGCLLVGTNMDNRLPLENGRFIAGTGCLVRAVEMAAQRQADIIGKPSRFIFDCVSQEYGINPERTVMVGDRLDTDILLGATCGLKTILTLTGVSTLGDVKNNQESDCVSKKKMVPDFYVDSIADLLPALQG

SEQ ID NO: 57855 - protein, 125 aa, Homo sapiens
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMAYGPAQHAISTEKIKAKYPDYEVTWANDGY

SEQ ID NO: 57856 - protein, 124 aa, Homo sapiens
MAVADLALIPDVDIDSDGVFKYVLIRVHSAPRSGAPAAESKEIVRGYKWAEYHADIYDKVSGDMQKQGCDCECLGGGRISHQSQDKKIHVYGYSMMRPTCVPLGASGPRIHHQGLWSCPARHFN

SEQ ID NO: 57857 - protein, 124 aa, Homo sapiens; identical to SEQ ID NO: 57856

SEQ ID NO: 57858 - protein, 451 aa, Homo sapiens
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKGRR

SEQ ID NO: 57859 - protein, 548 aa, Homo sapiens
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQDSDLKQYWMPDSQCKECYDCSEKFTTFRRRHHCRLCGQIFCSRCCNQEIPGKFMGYTGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKGRR

SEQ ID NO: 57860 - protein, 2098 aa, Homo sapiens
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQDSDLKQYWMPDSQCKECYDCSEKFTTFRRRHHCRLCGQIFCSRCCNQEIPGKFMGYTGDLRACTYCRKIALSYAHSTDSNSIGEDLNALSDSACSVSVLDPSEPRTPVGSRKASRNIFLEDDLAWQSLIHPDSSNTPLSTRLVSVQEDAGKSPARNRSASITNLSLDRSGSPMVPSYETSVSPQANRTYVRTETTEDERKILLDSVQLKDLWKKICHHSSGMEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLANSASPSKRTSVSSFQSTVDSDSAASISLNVELDNVNFHIKKPSKYPHVPPHPADQKEYLISDTGGQQLSISDAFIKESLFNRRVEEKSKELPFTPLGWHHNNLELLREENGEKQAMERLLSANHNHMMALLQQLLHSDSLSSSWRDIIVSLVCQVVQTVRPDVKNQDDDMDIRQFVHIKKIPGGKKFDSVVVNGFVCTKNIAHKKMSSCIKNPKILLLKCSIEYLYREETKFTCIDPIVLQEREFLKNYVQRIVDVRPTLVLVEKTVSRIAQDMLLEHGITLVINVKSQVLERISRMTQGDLVMSMDQLLTKPHLGTCHKFYMQIFQLPNEQTKTLMFFEGCPQHLGCTIKLRGGSDYELARVKEILIFMICVAYHSQLEISFLMDEFAMPPTLMQNPSFHSLIEGRGHEGAVQEQYGGGSIPWDPDIPPESLPCDDSSLLELRIVFEKGEQENKNLPQAVASVKHQEHSTTACPAGLPCAFFAPVPESLLPLPVDDQQDALGSEQPETLQQTVVLQDPKSQIRAFRDPLQDDTGLYVTEEVTSSEDKRKTYSLAFKQELKDVILCISPVITFREPFLLTEKGMRCSTRDYFAEQVYWSPLLNKEFKEMENRRKKQLLRDLSGLQGMNGSIQAKSIQVLPSHELVSTRIAEHLGDSQSLGRMLADYRARGGRIQPKNSDPFAHSKDASSTSSGQSGSKNEGDEERGLILSDAVWSTKVDCLNPINHQRLCVLFSSSSAQSSNAPSACVSPWIVTMEFYGKNDLTLGIFLERYCFRPSYQCPSMFCDTPMVHHIRRFVHGQGCVQIILKELDSPVPGYQHTILTYSWCRICKQVTPVVALSNESWSMSFAKYLELRFYGHQYTRRANAEPCGHSIHHDYHQYFSYNQMVASFSYSPIRLLEVCVPLPKIFIKRQAPLKVSLLQDLKDFFQKVSQVYVAIDERLASLKTDTFSKTREEKMEDIFAQKEMEEGEFKNWIEKMQARLMSSSVDTPQQLQSVFESLIAKKQSLCEVLQAWNNRLQDLFQQEKGRKRPSVPPSPGRLRQGEESKISAMDASPRNISPGLQNGEKEDRFLTTLSSQSSTSSTHLQLPTPPEVMSEQSVGGPPELDTASSSEDVFDGHLLGSTDSQVKEKSTMKAIFANLLPGNSYNPIPFPFDPDKHYLMYEHERVPIAVCEKEPSSIIAFALSCKEYRNALEELSKATQWNSAEEGLPTNSTSDSRPKSSSPIRLPEMSGGQTNRTTETEPQPTKKASGMLSFFRGTAGKSPDLSSQKRETLRGADSAYYQVGQTGKEGTENQGVEPQDEVDGGDTQKKQLINPHVELQFSDANAKFYCRLYYAGEFHKMREVILDSSEEDFIRSLSHSSPWQARGGKSGAAFYATEDDRFILKQMPRLEVQSFLDFAPHYFNYITNAVQQKRPTALAKILGVYRIGYKNSQNNTEKKLDLLVMENLFYGRKMAQVFDLKGSLRNRNVKTDTGKESCDVVLLDENLLKMVRDNPLYIRSHSKAVLRTSIHSDSHFLSSHLIIDYSLLVGRDDTSNELVVGIIDYIRTFTWDKKLEMVVKSTGILGGQGKMPTVVSPELYRTRFCEAMDKYFLMVPDHWTGLGLNC

SEQ ID NO: 57861 - protein, 1016 aa, Homo sapiens
MEFQDHRYWLRTHPNCIVGKELVNWLIRNGHIATRAQAIAIGQAMVDGRWLDCVSHHDQLFRDEYALYRPLQSTEFSETPSPDSDSVNSVEGHSEPSWFKDIKFDDSDTEQIAEEGDDNLAKYLISDTGGQQLSISDAFIKESLFNRRVEEKSKELPFTPLGWHHNNLELLREENGEKQAMERLLSANHNHMMALLQQLLHSDSLSSSWRDIIVSLVCQVVQTVRPDVKNQDDDMDIRQFVHIKKIPGGKKFDSVVVNGFVCTKNIAHKKMSSCIKNPKILLLKCSIEYLYREETKFTCIDPIVLQEREFLKNYVQRIVDVRPTLVLVEKTVSRIAQDMLLEHGITLVINVKSQVLERISRMTQGDLVMSMDQLLTKPHLGTCHKFYMQIFQLPNEQTKTLMFFEGCPQHLGCTIKLRGGSDYELARVKEILIFMICVAYHSQLEISFLMDEFAMPPTLMQNPSFHSLIEGRGHEGAVQEQYGGGSIPWDPDIPPESLPCDDSSLLELRIVFEKGEQENKNLPQAVASVKHQEHSTTACPAGLPCAFFAPVPESLLPLPVDDQQDALGSEQPETLQQTVVLQDPKSQIRAFRDPLQDDTGLYVTEEVTSSEDKRKTYSLAFKQELKDVILCISPVITFREPFLLTEKGMRCSTRDYFAEQVYWSPLLNKEFKEMENRRKKQLLRDLSGLQGMNGSIQAKSIQVLPSHELVSTRIAEHLGDSQSLGRMLADYRARGGRIQPKNSDPFAHSKDASSTSSGQSGSKNEGDEERGLILSDAVWSTKVDCLNPINHQRLCVLFSSSSAQSSNAPSACVSPWIVTMEFYGKNDLTLGIFLERYCFRPSYQCPSMFCDTPMVHHIRRFVHGQGCVQIILKELDSPVPGYQHTILTYSWCRICKQVTPVVALSNESWSMSFAKYLELRFYGHQYTRRANAEPCGHSIHHDYHQYFSYNQMVASFSYSPIRLLEVCVPLPKIFIKRQAPLKVSLLQDLKDFFQKVSQVYVAIDERLASLKTDTFS

SEQ ID NO: 57862 - protein, 173 aa, Homo sapiens
MRPWSSPAQLVAGAQPAGRGDPLGPRPIPPPRFRRASSQREPPYPRPAEPALELAGSKCQPDTPAASLCPADSPSQHRVMPPGPASWANVGSRPHTVANGHELFEVSEERDEEVAAFCHMLDILRSGSDIQDYFLTGYVWSAVTPSPEHLGDEVNLKVTVLCDRLQEALTFTC

SEQ ID NO: 57863 - protein, 1634 aa, Homo sapiens
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEVSSLPLVLASAPSWEWACLPDIYVLLKQWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 57864 - protein, 119 aa, Homo sapiens
MFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRVILASVVGGRESKTCSAVSSSGD

SEQ ID NO: 57865 - protein, 131 aa, Homo sapiens
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIF

SEQ ID NO: 57866 - protein, 1606 aa, Homo sapiens
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRGWKEGRGPLDFSKDTSGKPVARSKTMPPQVPPRTYASRYGNRKNATPGKNRRISAAPVGSRPHTVANGHELFEVSEERDEEVAAFCHMLDILRSGSDIQDYFLTGYVWSAVTPSPEHLGDEVNLKVTVLCDRLQEALTFTCNCSSTVDLLIYQTLCYTHDDLRNVDVGDFVLKPCGLEEFLQNKHALGSHEYIQYCRKFDIDIRLQLMEQKVVRSDLARTVNDDQSPSTLNYLVHLQERPVKQTISRQALSLLFDTYHNEVDAFLLADGDFPLKADRVVQSVKAICNALAAVETPEITSALNQLPPCPSRMQPKIQKDPSVLAVRENREKVVEALTAAILDLVELYCNTFNADFQTAVPGSRKHDLVQEACHFARSLAFTVYATHRIPIIWATSYEDFYLSCSLSHGGKELCSPLQTRRAHFSKYLFHLIVWDQQICFPVQVNRLPRETLLCATLYALPIPPPGSSSEANKQRRVPEALGWVTTPLFNFRQVLTCGRKLLGLWPATQENPSARWSAPNFHQPDSVILQIDFPTSAFDIKFTSPPGDKFSPRYEFGSLREEDQRKLKDIMQKESLYWLTDADKKRLWEKRYYCHSEWTHMNHQDALGLLHATFPDQEVRRMAVQWIGSLSDAELLDYLPQLVQALKYECYLDSPLVRFLLKRAVSDLRVTHYFFWLLKDGLKDSQFSIRYQYLLAALLCCCGKGLREEFNRQCWLVNALAKLAQQVREAAPSARQGILRTGLEEVKQFFALNGSCRLPLSPSLLVKGIVPRDCSYFNSNAVPLKLSFQNVDPLGENIRVIFKCGDDLRQDMLTLQMIRIMSKIWVQEGLDMRMVIFRCFSTGRGRGMVEMIPNAETLRKIQVEHGVTGSFKDRPLADWLQKHNPGEDEYEKAVENFIYSCAGCCVATYVLGICDRHNDNIMLKTTGHMFHIDFGRFLGHAQMFGNIKRDRAPFVFTSDMAYVINGGDKPSSRFHDFVDLCCQAYNLIRKHTHLFLNLLGLMLSCGIPELSDLEDLKYVYDALRPQDTEANATTYFTRLIESSLGSVATKLNFFIHNLAQMKFTGSDDRLTLSFASRTHTLKSSGRISDVFLCRHEKIFHPNKGYIYVVKVMRENTHEATYIQRTFEEFQELHNKLRLLFPSSHLPSFPSRFVIGRSRGEAVAERRREELNGYIWHLIHAPPEVAECDLVYTFFHPLPRDEKAMGTSPAPKSSDGTWARPVGKVGGEVKLSISYKNNKLFIMVMHIRGLQLLQDGNDPDPYVKIYLLPDPQKTTKRKTKVARKTCNPTYNEMLVYDGIPKGDLQQRELQLSVLSEQGFWENVLLGEVNIRLRELDLAQEKTGWFALGSRSHGTL

SEQ ID NO: 57867 - protein, 60 aa, Homo sapiens
MSSTQGNGEHWKSLESVGISRKELAMAEALQMEYDALSRLRHDKEENRAKQNADPSLISW

SEQ ID NO: 57868 - protein, 173 aa, Homo sapiens; identical to SEQ ID NO: 57862

SEQ ID NO: 57869 - protein, 1445 aa, Homo sapiens
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHRINFPLEIKSLPRESMLTVKLFGIACATNNANLLAWTCLPLFPKEKSILGSMLFSMTLQSEPPVEMITPGVWDVSQPSPVTLQIDFPATGWEYMKPDSEENRSNLEEPLKECIKHIARLSQKQTPLLLSEEKKRYLWFYRFYCNNENCSLPLVLGSAPGWDERTVSEMHTILRRWTFSQPLEALGLLTSSFPDQEIRKVAVQQLDNLLNDELLEYLPQLVQAVKFEWNLESPLVQLLLHRSLQSIQVAHRLYWLLKNAENEAYFKSWYQKLLAALQFCAGKALNDEFSKEQKLIKILGDIGERVKSASDHQRQEVLKKEIGRLEEFFQDVNTCHLPLNPALCIKGIDHDACSYFTSNALPLKITFINANPMGKNISIIFKAGDDLRQDMLVLQLIQVMDNIWLQEGLDMQMIIYRCLSTGKDQGLVQMVPDAVTLAKIHRHSGLIGPLKENTIKKWFSQHNHLKADYEKALRNFFYSCAGWCVVTFILGVCDRHNDNIMLTKSGHMFHIDFGKFLGHAQTFGGIKRDRAPFIFTSEMEYFITEGGKNPQHFQDFVELCCRAYNIIRKHSQLLLNLLEMMLYAGLPELSGIQDLKYVYNNLRPQDTDLEATSHFTKKIKESLECFPVKLNNLIHTLAQMSAISPAKSTSQTFPQESCLLSTTRSIERATILGFSKKSSNLYLIQVTHSNNETSLTEKSFEQFSKLHSQLQKQFASLTLPEFPHWWHLPFTNSDHRRFRDLNHYMEQILNVSHEVTNSDCVLSFFLSEAVQQTVEESSPVYLGEKFPDKKPKVQLVISYEDVKLTILVKHMKNIHLPDGSAPSAHVEFYLLPYPSEVRRRKTKSVPKCTDPTYNEIVVYDEVTELQGHVLMLIVKSKTVFVGAINIRLCSVPLDKEKWYPLGNSII

SEQ ID NO: 57870 - protein, 1445 aa, Homo sapiens; identical to SEQ ID NO: 57869

SEQ ID NO: 57871 - protein, 1486 aa, Homo sapiens
MAYSWQTDPNPNESHEKQYEHQEFLFVNQPHSSSQVSLGFDQIVDEISGKIPHYESEIDENTFFVPTAPKWDSTGHSLNEAHQISLNEFTSKSRELSWHQVSKAPAIGFSPSVLPKPQNTNKECSWGSPIGKHHGADDSRFSILAPSFTSLDKINLEKELENENHNYHIGFESSIPPTNSSFSSDFMPKEENKRSGHVNIVEPSLMLLKGSLQPGMWESTWQKNIESIGCSIQLVEVPQSSNTSLASFCNKVKKIRERYHAADVNFNSGKIWSTTTAFPYQLFSKTKFNIHIFIDNSTQPLHFMPCANYLVKDLIAEILHFCTNDQLLPKDHILSVCGSEEFLQNDHCLGSHKMFQKDKSVIQLHLQKSREAPGKLSRKHEEDHSQFYLNQLLEFMHIWKVSRQCLLTLIRKYDFHLKYLLKTQENVYNIIEEVKKICSVLGCVETKQITDAVNELSLILQRKGENFYQSSETSAKGLIEKVTTELSTSIYQLINVYCNSFYADFQPVNVPRCTSYLNPGLPSHLSFTVYAAHNIPETWVHSYKAFSFTCWLTYAGKKLCQVRNYRNIPDKKLFFFLVNWNETINFPLEIKSLPRESMLTVKLFGIACATNNANLLAWTCLPLFPKEKSILGSMLFSMTLQSEPPVEMITPGVWDVSQPSPVTLQIDFPATGWEYMKPDSEENRSNLEEPLKECIKHIARLSQKQTPLLLSEEKKRYLWFYRFYCNNENCSLPLVLGSAPGWDERTVSEMHTILRRWTFSQPLEALGLLTSSFPDQEIRKVAVQQLDNLLNDELLEYLPQLVQAVKFEWNLESPLVQLLLHRSLQSIQVAHRLYWLLKNAENEAYFKSWYQKLLAALQFCAGKALNDEFSKEQKLIKILGDIGERVKSASDHQRQEVLKKEIGRLEEFFQDVNTCHLPLNPALCIKGIDHDACSYFTSNALPLKITFINANPMGKNISIIFKAGDDLRQDMLVLQLIQVMDNIWLQEGLDMQMIIYRCLSTGKDQGLVQMVPDAVTLAKIHRHSGLIGPLKENTIKKWFSQHNHLKADYEKALRNFFYSCAGWCVVTFILGVCDRHNDNIMLTKSGHMFHIDFGKFLGHAQTFGGIKRDRAPFIFTSEMEYFITEGGKNPQHFQDFVELCCRAYNIIRKHSQLLLNLLEMMLYAGLPELSGIQDLKYVYNNLRPQDTDLEATSHFTKKIKESLECFPVKLNNLIHTLAQMSAISPAKSTSQTFPQESCLLSTTRSIERATILGFSKKSSNLYLIQVTHSNNETSLTEKSFEQFSKLHSQLQKQFASLTLPEFPHWWHLPFTNSDHRRFRDLNHYMEQILNVSHEVTNSDCVLSFFLSEAVQQTVEESSPVYLGEKFPDKKPKVQLVISYEDVKLTILVKHMKNIHLPDGSAPSAHVEFYLLPYPSEVRRRKTKSVPKCTDPTYNEIVVYDEVTELQGHVLMLIVKSKTVFVGAINIRLCSVPLDKEKWYPLGNSII

SEQ ID NO: 57872 - protein, 137 aa, Homo sapiens
MTMETLPKVLEVDEKSPEAKDLLPSQTASSLCISSRSESVWTTTPRSNWEIYRKPIVIMSVGGAILLFGVVITCLAYTLKLSDKSLSILKMVGPGFLSLGLMMLVCGLVWVPIIKKKQKHRQKSNFLRSLKSFFLTR

SEQ ID NO: 57873 - protein, 137 aa, Homo sapiens; identical to SEQ ID NO: 57872

SEQ ID NO: 57874 - protein, 52 aa, Homo sapiens
MEKVQYLTRSAIRRASTIEMPQQARQKLQNLFINFCLILICLLLICIIVMLL

SEQ ID NO: 57875 - protein, 456 aa, Homo sapiens
MPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVIKLSLEISLFLNKLLVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 57876 - protein, 440 aa, Homo sapiens
MPPGPWESCFWVGGLILWLSVGSSGDAPPTPQPKCADFQSANLFEGTDLKVQFLLFVPSNPSCGQLVEGSSDLQNSGFNATLGTKLIIHGFRVLGTKPSWIDTFIRTLLRATNANVIAVDWIYGSTGVYFSAVKNVLGVSESSIHIIGVSLGAHVGGMVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 57877 - protein, 283 aa, Homo sapiens
MVGQLFGGQLGQITGLDPAGPEYTRASVEERLDAGDALFVEAIHTDTDNLGIRIPVGHVDYFVNGGQDQPGCPTFFYAGYSYLICDHMRAVHLYISALENSCPLMAFPCASYKAFLAGRCLDCFNPFLLSCPRIGLVEQGGVKIEPLPKEVKVYLLTTSSAPYCMHHSLVEFHLKELRNKDTNIEVTFLSSNITSSSKITIPKQQRYGKGIIAHATPQCQINQVKFKFQSSNRVWKKDRTTIIGKFCTALLPVNDREKMVCLPEPVNLQASVTVSCDLKIACV

SEQ ID NO: 57878 - protein, 551 aa, Homo sapiens
MRTRPRPRLRRTENFLTAVHHGKKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 57879 - protein, 1463 aa, Homo sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNNETIKWFDGTPTDQSNWGIRKPDTDYFKPHHCVALRIPEGLWQLSPCQEKKGFICKMEADIHTAEALPEKGPSHSIIPLAVVLTLIVIVAICTLSFCIYKHNGGFFRRLAGFRNPYYPATNFSTVYLEENILISDLEKSDQ

SEQ ID NO: 57880 - protein, 1324 aa, Homo sapiens
MLLSPSLLLLLLLGAPRGCAEGVAAALTPERLLEWQDKGIFVIQSESLKKCIQAGKSVLTLENCKQANKHMLWKWVSNHGLFNIGGSGCLGLNFSAPEQPLSLYECDSTLVSLRWRCNRKMITGPLQYSVQVAHDNTVVASRKYIHKWISYGSGGGDICEYLHKDLHTIKGNTHGMPCMFPFQYNHQWHHECTREGREDDLLWCATTSRYERDEKWGFCPDPTSAEVGCDTIWEKDLNSHICYQFNLLSSLSWSEAHSSCQMQGGTLLSITDETEENFIREHMSSKTVEVWMGLNQLDEHAGWQWSDGTPLNYLNWSPEVNFEPFVEDHCGTFSSFMPSAWRSRDCESTLPYICKKYLNHIDHEIVEKDAWKYYATHCEPGWNPYNRNCYKLQKEEKTWHEALRSCQADNSALIDITSLAEVEFLVTLLGDENASETWIGLSSNKIPVSFEWSNDSSVIFTNWHTLEPHIFPNRSQLCVSAEQSEGHWKVKNCEERLFYICKKAGHVLSDAESGCQEGWERHGGFCYKIDTVLRSFDQASSGYYCPPALVTITNRFEQAFITSLISSVVKMKDSYFWIALQDQNDTGEYTWKPVGQKPEPVQYTHWNTHQPRYSGGCVAMRGRHPLGRWEVKHCRHFKAMSLCKQPVENQEKAEYEERWPFHPCYLDWESEPGLASCFKVFHSEKVLMKRTWREAEAFCEEFGAHLASFAHIEEENFVNELLHSKFNWTEERQFWIGFNKRNPLNAGSWEWSDRTPVVSSFLDNTYFGEDARNCAVYKANKTLLPLHCGSKREWICKIPRDVKPKIPFWYQYDVPWLFYQDAEYLFHTFASEWLNFEFVCSWLHSDLLTIHSAHEQEFIHSKIKALSKYGASWWIGLQEERANDEFRWRDGTPVIYQNWDTGRERTVNNQSQRCGFISSITGLWGSEECSVSMPSICKRKKVWLIEKKKDTPKQHGTCPKGWLYFNYKCLLLNIPKDPSSWKNWTHAQHFCAEEGGTLVAIESEVEQAFITMNLFGQTTSVWIGLQNDDYETWLNGKPVVYSNWSPFDIINIPSHNTTEVQKHIPLCALLSSNPNFHFTGKWYFEDCGKEGYGFVCEKMQDTSGHGVNTSDMYPMPNTLEYGNRTYKIINANMTWYAAIKTCLMHKAQLVSITDQYHQSFLTVVLNRLGYAHWIGLFTTDNGLNFDWSDGTKSSFTFWKDEESSLLGDCVFADSNGRWHSTACESFLQGAICHVPPETRQSEHPELCSETSIPWIKFKSNCYSFSTVLDSMSFEAAHEFCKKEGSNLLTIKDEAENAFLLEELFAFGSSVQMVWLNAQFDGNSK

SEQ ID NO: 57881 - protein, 527 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAG

SEQ ID NO: 57882 - protein, 541 aa, Homo sapiens
MGSSEVSIIPGLQKEEKAAVERRRLHVLKALKKLRIEADEAPVVAVLGSGGGLRAHIACLGVLSEMKEQGLLDAVTYLAGVSGSTWAISSLYTNDGDMEALEADLKHRFTRQEWDLAKSLQKTIQAARSENYSLTDFWAYMVISKQTRELPESHLSNMKKPVEEGTLPYPIFAAIDNDLQPSWQEARAPETWFEFTPHHAGFSALGAFVSITHFGSKFKKGRLVRTHPERDLTFLRGLWGSALGNTEVIREYIFDQLRNLTLKGLWRRAVANAKSIGHLIFARLLRLQESSQGEHPPPEDEGGEPEHTWLTEMLENWTRTSLEKQEQPHEDPERKGSLSNLMDFVKKTGICASKWEWGTTHNFLYKHGGIRDKIMSSRKHLHLVDAGLAINTPFPLVLPPTREVHLILSFDFSAGDPFETIRATTDYCRRHKIPFPQVEEAELDLWSKAPASCYILKGETGPVVMHFPLFNIDACGGDIEAWSDTYDTFKLADTYTLDVVVLLLALAKKNVRENKKKILRELMNVAGLYYPKDSARSCCLA

SEQ ID NO: 57883 - protein, 818 aa, Homo sapiens
MESLSPGGPPGHPYQGEASTCWQLTVRVLEARNLRWADLLSEADPYVILQLSTAPGMKFKTKTLTDTSHPVWNEAFRFLIQSQVKNVLELSIYDEDSVTEDDICFKVLYDISEVLPGKLLRKTFSQSPQGEEELDVEFLMEETSDRPENLITNKVIVARELSCLDVHLDSTGSTAVVADQDKLELELVLKGSYEDTQTSFLGTASAFRFHYMAALETELSGRLRSSRSNGWNGDNSAGYLTVPLRPLTIGKEVTMDVPAPNAPGVRLQLKAEGCPEELAVHLGFNLCAEEQAFLSRRKQVVAKALKQALQLDRDLQEDEVPVVGIMATGGGARAMTSLYGHLLALQKLGLLDCVTYFSGISGSTWTMAHLYGDPEWSQRDLEGPIRYAREHLAKSKLEVFSPERLASYRRELELRAEQGHPTTFVDLWALVLESMLHGQVMDQKLSGQRAALERGQNPLPLYLSLNVKENNLETLDFKEWVEFSPYEVGFLKYGAFVPPELFGSEFFMGRLMRRIPEPRICFLEAIWSNIFSLNLLDAWYDLTSSGESWKQHIKDKTRSLEKEPLTTSGTSSRLEASWLQPGTALAQAFKGFLTGRPLHQRSPNFLQGLQLHQDYCSHKDFSTWADYQLDSMPSQLTPKEPRLCLVDAAYFINTSSPSMFRPGRRLDLILSFDYSLSAPFEALQQTELYCRARGLPFPRVEPSPQDQHQPRECHLFSDPACPEAPILLHFPLVNASFKDHSAPGVQRSPAELQGGQVDLTGATCPYTLSNMTYKEEDFERLLRLSDYNVQTSQGAILQALRTALKHRTLEARPPRAQT

SEQ ID NO: 57884 - protein, 441 aa, Homo sapiens
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKDSIDREKIAVIGHSFGGATVIQTLSEDQRFRCGIALDAWMFPLGDEVYSRIPQPLFFINSEYFQYPANIIKMKKCYSPDKERKMITIRGSVHQNFADFTFATGKIIGHMLKLKGDIDSNVAIDLSNKASLAFLQKHLGLHKDFDQWDCLIEGDDENLIPGTNINTTNQHIMLQNSSGIEKYN

SEQ ID NO: 57885 - protein, 441 aa, Homo sapiens; identical to SEQ ID NO: 57884

SEQ ID NO: 57886 - protein, 219 aa, Homo sapiens
MAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKVSYKK

SEQ ID NO: 57887 - protein, 137 aa, Homo sapiens
MTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDMEQLKVSYKK

SEQ ID NO: 57888 - protein, 162 aa, Homo sapiens
MRAPIPEPKPGDLIEIFRPFYRHWAIYVGDGYVVHLAPPSEVAGAGAASVMSALTDKAIVKKELLYDVAGSDKYQVNNKHDDKYSPLPCSKIIQRAEELVGQEVLYKLTSENCEHFVNELRYGVARSDQVRDVIIAASVAGMGLAAMSLIGVMFSRNKRQKQ

SEQ ID NO: 57889 - protein, 162 aa, Homo sapiens; identical to SEQ ID NO: 57888

SEQ ID NO: 57890 - protein, 1458 aa, Homo sapiens
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 57891 - protein, 488 aa, Homo sapiens
MEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVHYSPQNFTDNIGKALDILHAEVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYRESKPGFLSDSWVSKSNRKCTRKAPNP

SEQ ID NO: 57892 - protein, 1447 aa, Homo sapiens
MGLRPGIFLLELLLLLGQGTPQIHTSPRKSTLEGQLWPETLKNSPFPCNPNKLGVNMPSKSVHSLKPSDIKFVAAIGNLEIPPDPGTGDLEKQDWTERPQQVCMGVMTVLSDIIRYFSPSVPMPVCHTGKRVIPHDGAEDLWIQAQELVRNMKENLQLDFQFDWKLINVFFSNASQCYLCPSAQQAPSLSTVLLSQNGLAAGGVDELMGVLDYLQQEVPRAFVNLVDLSEVAEVSRQYHGTWLSPAPEPCNCSEETTRLAKVVMQWSYQEAWNSLLASSRYSEQESFTVVFQPFFYETTPSLHSEDPRLQDSTTLAWHLWNRMMEPAGEKDEPLSVKHGRPMKCPSQESPYLFSYRNSNYLTRLQKPQDKLEVREGAEIRCPDKDPSDTVPTSVHRLKPADINVIGALGDSLTAGNGAGSTPGNVLDVLTQYRGLSWSVGGDENIGTVTTLANILREFNPSLKGFSVGTGKETSPNAFLNQAVAGGRAEDLPVQARRLVDLMKNDTRIHFQEDWKIITLFIGGNDLCDFCNDLVPRAFVNLVTVLEIVNLRELYQEKKVYCPRMILRSLCPCVLKFDDNSTELATLIEFNKKFQEKTHQLIESGRYDTREDFTVVVQPFFENVDMPKTSEGLPDNSFFAPDCFHFSSKSHSRAASALWNNMLEPVGQKTTRHKFENKINITCPNQVQPFLRTYKNSMQGHGTWLPCRDRAPSALHPTSVHALRPADIQVVAALGDSLTAGNGIGSKPDDLPDVTTQYRGLSYSAGGDGSLENVTTLPNILREFNRNLTGYAVGTGDANDTNAFLNQAVPGAKAEDLMSQVQTLMQKMKDDHRVNFHEDWKVITVLIGGSDLCDYCTDSNLYSAANFVHHLRNALDVLHREVPRVLVNLVDFLNPTIMRQVFLGNPDKCPVQQASVLCNCVLTLRENSQELARLEAFSRAYRSSMRELVGSGRYDTQEDFSVVLQPFFQNIQLPVLADGLPDTSFFAPDCIHPNQKFHSQLARALWTNMLEPLGSKTETLDLRAEMPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 57893 - protein, 423 aa, Homo sapiens
MPITCPTQNEPFLRTPRNSNYTYPIKPAIENWGSDFLCTEWKASNSVPTSVHQLRPADIKVVAALGDSLTTAVGARPNNSSDLPTSWRGLSWSIGGDGNLETHTTLPNILKKFNPYLLGFSTSTWEGTAGLNVAAEGARARDMPAQAWDLVERMKNSPDINLEKDWKLVTLFIGVNDLCHYCENPEAHLATEYVQHIQQALDILSEELPRAFVNVVEVMELASLYQGQGGKCAMLAAQNNCTCLRHSQSSLEKQELKKVNWNLQHGISSFSYWHQYTQREDFAVVVQPFFQNTLTPLNERGDTDLTFFSEDCFHFSDRGHAEMAIALWNNMLEPVGRKTTSNNFTHSRAKLKCPSPESPYLYTLRNSRLLPDQAEEAPEVLYWAVPVAAGVGLVVGIIGTVVWRCRRGGRREDPPMSLRTVAL

SEQ ID NO: 57894 - protein, 1167 aa, Homo sapiens
MAGAQPGVHALQLEPPTVVETLRRGSKFIKWDEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 57895 - protein, 1216 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKLQVELEQEYQDKFKRLPLEILEFVQEAMKGKISEDSNHGSAPLSLSSDPGKVNHKTPSSEELGGDIPGKEFDTPL

SEQ ID NO: 57896 - protein, 223 aa, Homo sapiens
MRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEGGFLHDEIMRLTRNTLEKLMALPLTHVVPIQSKMLS

SEQ ID NO: 57897 - protein, 1173 aa, Homo sapiens
MAGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRNDSIPQEDFTPEVYRVFLNNLCPRPEIDNIFSEFGAKSKPYLTVDQMMDFINLKQRDPRLNEILYPPLKQEQVQVLIEKYEPNNSLARKGQISVDGFMRYLSGEENGVVSPEKLDLNEDMSQPLSHYFINSSHNTYLTAGQLAGNSSVEMYRQVLLSGCRCVELDCWKGRTAEEEPVITHGFTMTTEISFKEVIEAIAECAFKTSPFPILLSFENHVDSPKQQAKMAEYCRLIFGDALLMEPLEKYPLESGVPLPSPMDLMYKILVKNKKKSHKSSEGSGKKKLSEQASNTYSDSSSMFEPSSPGAGEADTESDDDDDDDDCKKSSMDEGTAGSEAMATEEMSNLVNYIQPVKFESFEISKKRNKSFEMSSFVETKGLEQLTKSPVEFVEYNKMQLSRIYPKGTRVDSSNYMPQLFWNAGCQMVALNFQTMDLAMQINMGMYEYNGKSGYRLKPEFMRRPDKHFDPFTEGIVDGIVANTLSVKIISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEADPGETPSEAPSEARTTPAENGVNHTTTLTPKPPSQALHSQPAPGSVKAPAKTEDLIQSVLTEVEAQTIEELKQQKSFVKLQKKHYKEMKDLVKRHHKKTTDLIKEHTTKYNEIQNDYLRRRAALEKSAKKDSKKKSEPSSPDHGSSTIEQDLAALDAEMTQKLIDLKDKQQQQLLNLRQEQYYSEKYQKREHIKLLIQKLTDVAEECQNNQLKKLKEICEKEKKELKKKMDKKRQEKITEAKSKDKSQMEEEKTEMIRSYIQEVVQYIKRLEEAQSKRQEKLVEKHKEIRQQILDEKPKGEGSSSFLSETCHEDPSVSPNFTPPNPQALKW

SEQ ID NO: 57898 - protein, 1173 aa, Homo sapiens; identical to SEQ ID NO: 57897

SEQ ID NO: 57899 - protein, 232 aa, Homo sapiens
AGAQPGVHALQLKPVCVSDSLKKGTKFVKWDDDSTIVTPIILRTDPQGFFFYWTDQNKETELLDLSLVKDARCGRHAKAPKDPKLRELLDVGNIGRLEQRMITVVYGPDLVNISHLNLVAFQEEVAKEWTNEVFSLATNLLAQNMSRDAFLEKAYTKLKLQVTPEGRIPLKNIYRLFSADRKRVETALEACSLPSSRVEKANEAAKSEQSCGKAPPKHFHLHFIKQNKMLEP

SEQ ID NO: 57900 - protein, 30 aa, Homo sapiens
EEAQSKRQEKLVEKHKEIRQQILDEKPKVP

SEQ ID NO: 57901 - protein, 196 aa, Homo sapiens
IISGQFLSDKKVGTYVEVDMFGLPVDTRRKAFKTKTSQGNAVNPVWEEEPIVFKKVVLPTLACLRIAVYEEGGKFIGHRILPVQAIRPGYHYICLRNERNQPLTLPAVFVYIEVKDYVPDTYADVIEALSNPIRYVNLMEQRAKQLAALTLEDEEEVKKEGGFLHDEIMRLTRNTLEKLMALPLTHVVPIQSKMLS

SEQ ID NO: 57902 - protein, 1136 aa, Homo sapiens [sequence omitted]

SEQ ID NO: 57903 - protein, 1093 aa, Homo sapiens [sequence omitted]

SEQ ID NO: 57904 - protein, 1185 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAGEGTVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 57905 - protein, 1181 aa, Homo sapiens
MSLLNPVLLPPKVKAYLSQGERFIKWDDETTVASPVILRVDPKGYYLYWTYQSKEMEFLDITSIRDTRFGKFAKMPKSQKLRDVFNMDFPDNSFLLKTLTVVSGPDMVDLTFHNFVSYKENVGKAWAEDVLALVKHPLTANASRSTFLDKILVKLKMQLNSEGKIPVKNFFQMFPADRKRVEAALSACHLPKGKNDAINPEDFPEPVYKSFLMSLCPRPEIDEIFTSYHAKAKPYMTKEHLTKFINQKQRDSRLNSLLFPPARPDQVQGLIDKYEPSGINAQRGQLSPEGMVWFLCGPENSVLAQDKLLLHHDMTQPLNHYFINSSHNTYLTAGQFSGLSSAEMYRQVLLSGCRCVELDCWKGKPPDEEPIITHGFTMTTDIFFKEAIEAIAESAFKTSPYPIILSFENHVDSPRQQAKMAEYCRTIFGDMLLTEPLEKFPLKPGVPLPSPEDLRGKILIKNKKNQFSGPTSSSKDTGGEAEGSSPPSAPAVWAGEEGTELEEEEVEEEEEEESGNLDEEEIKKMQSDEGTAGLEVTAYEEMSSLVNYIQPTKFVSFEFSAQKNRSYVISSFTELKAYDLLSKASVQFVDYNKRQMSRIYPKGTRMDSSNYMPQMFWNAGCQMVALNFQTMDLPMQQNMAVFEFNGQSGYLLKHEFMRRPDKQFNPFSVDRIDVVVATTLSITVISGQFLSERSVRTYVEVELFGLPGDPKRRYRTKLSPSTNSINPVWKEEPFVFEKILMPELASLRVAVMEEGNKFLGHRIIPINALNSGYHHLCLHSESNMPLTMPALFIFLEMKDYIPGAWADLTVALANPIKFFSAHDTKSVKLKEAMGGLPEKPFPLASPVASQVNGALAPTSNGSPAARAGAREEAMKEAAEPRTASLEELRELKGVVKLQRRHEKELRELERRGARRWEELLQRGAAQLAELGPPGVGGVGACKLGPGKGSRKKRSLPREESAGAAPGEGPEGVDGRVRELKDRLELELLRQGEEQYECVLKRKEQHVAEQISKMMELAREKQAAELKALKETSENDTKEMKKKLETKRLERIQGMTKVTTDKMAQERLKREINNSHIQEVVQVIKQMTENLERHQEKLEEKQAACLEQIREMEKQFQKEALAEYEARMKGLEAEVKESVRACLRTCFPSEAKDKPERACECPPELCEQDPLIAKADAQESRL

SEQ ID NO: 57906 - protein, 1234 aa, Homo sapiens
MAGAQPGVHALQLEPPTVVETLRRGSKFIKWDEETSSRNLVTLRVDPNGFFLYWTGPNMEVDTLDISSIRDTRTGRYARLPKDPKIREVLGFGGPDARLEEKLMTVVSGPDPVNTVFLNFMAVQDDTAKVWSEELFKLAMNILAQNASRNTFLRKAYTKLKLQVNQDGRIPVKNILKMFSADKKRVETALESCGLKFNRSESIRPDEFSLEIFERFLNKLCLRPDIDKILLEIGAKGKPYLTLEQLMDFINQKQRDPRLNEVLYPPLRPSQARLLIEKYEPNQQFLERDQMSMEGFSRYLGGEENGILPLEALDLSTDMTQPLSAYFINSSHNTYLTAGQLAGTSSVEMYRQALLWGCRCVELDVWKGRPPEEEPFITHGFTMTTEVPLRDVLEAIAETAFKTSPYPVILSFENHVDSAKQQAKMAEYCRSIFGDALLIEPLDKYPLAPGVPLPSPQDLMGRILVKNKKRHRPSAGGPDSAGRKRPLEQSNSALSESSAATEPSSPQLGSPSSDSCPGLSNGEEVGLEKPSLEPQKSLGDEGLNRGPYVLGPADREDEEEDEEEEEQTDPKKPTTDEGTASSEVNATEEMSTLVNYIEPVKFKSFEAARKRNKCFEMSSFVETKAMEQLTKSPMEFVEYNKQQLSRIYPKGTRVDSSNYMPQLFWNVGCQLVALNFQTLDVAMQLNAGVFEYNGRSGYLLKPEFMRRPDKSFDPFTEVIVDGIVANALRVKVISGQFLSDRKVGIYVEVDMFGLPVDTRRKYRTRTSQGNSFNPVWDEEPFDFPKVVLPTLASLRIAAFEEGGKFVGHRILPVSAIRSGYHYVCLRNEANQPLCLPALLIYTEASDYIPDDHQDYAEALINPIKHVSLMDQRARQLAALIGESEAQAGQETCQDTQSQQLGSQPSSNPTPSPLDASPRRPPGPTTSPASTSLSSPGQRDDLIASILSEVAPTPLDELRGHKALVKLRSRQERDLRELRKKHQRKAVTLTRRLLDGLAQAQAEGRCRLRPGALGGAADVEDTKEGEDEAKRYQEFQNRQVQSLLELREAQVDAEAQRRLEHLRQALQRLREVVLDANTTQFKRLKEMNEREKKELQKILDRKRHNSISEAKMRDKHKKEAELTEINRRHITESVNSIRRLEEAQKQRHDRLVAGQQQVLQQLAEEEPKLLAQLAQECQEQRARLPQEIRRSLLGEMPEGLGDGPLVACASNGHAPGSSGHLSGADSESQEENTQL

SEQ ID NO: 57907 - protein, 1234 aa, Homo sapiens; identical to SEQ ID NO: 57906

SEQ ID NO: 57908 - protein, 1175 aa, Homo sapiens
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 57909 - protein, 1194 aa, Homo sapiens
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQLLKSCHAVSQTQGEGDAADGEIGSRDGPQTSNSSMKLQNAN

SEQ ID NO: 57910 - protein, 1187 aa, Homo sapiens
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTYMVAENPEVTKQWVEGLRSIIHNFRANNVSPMTCLKKHWMKLAFMTNTNGKIPVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKASDDLEHENNKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 57911 - protein, 1175 aa, Homo sapiens; identical to SEQ ID NO: 57908

SEQ ID NO: 57912 - protein, 1194 aa, Homo sapiens; identical to SEQ ID NO: 57909

SEQ ID NO: 57913 - protein, 113 aa, Homo sapiens
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNISFTY

SEQ ID NO: 57914 - protein, 1023 aa, Homo sapiens
PVRSITRTFASGKTEKVIFQALKELGLPSGKNDEIEPTAFSYEKFYELTQKICPRTDIEDLFKKINGDKTDYLTVDQLVSFLNEHQRDPRLNEILFPFYDAKRAMQIIEMYEPDEDLKKKGLISSDGFCRYLMSDENAPVFLDRLELYQEMDHPLAHYFISSSHNTYLTGRQFGGKSSVEMYRQVLLAGCRCVELDCWDGKGEDQEPIITHGKAMCTDILFKDVIQAIKETAFVTSEYPVILSFENHCSKYQQYKMSKYCEDLFGDLLLKQALESHPLEPGRALPSPNDLKRKILIKNKRLKPEVEKKQLEALRSMMEAGESASPANILEDDNEEEIESADQEEEAHPEFKFGNELSADDLGHKEAVANSVKKASDDLEHENNKKGLVTVEDEQAWMASYKYVGATTNIHPYLSTMINYAQPVKFQGFHVAEERNIHYNMSSFNESVGLGYLKTHAIEFVNYNKRQMSRIYPKGGRVDSSNYMPQIFWNAGCQMVSLNYQTPDLAMQLNQGKFEYNGSCGYLLKPDFMRRPDRTFDPFSETPVDGVIAATCSVQVISGQFLSDKKIGTYVEVDMYGLPTDTIRKEFRTRMVMNNGLNPVYNEESFVFRKVILPDLAVLRIAVYDDNNKLIGQRILPLDGLQAGYRHISLRNEGNKPLSLPTIFCNIVLKTYVPDGFGDIVDALSDPKKFLSITEKRADQMRAMGIETSDIADVPSDTSKNDKKGKANTAKANVTPQSSSELRPTTTAALASGVEAKKGIELIPQVRIEDLKQMKAYLKHLKKQQKELNSLKKKHAKEHSTMQKLHCTQVDKIVAQYDKEKSTHEKILEKAMKKKGGSNCLEMKKETEIKIQTLTSDHKSKVKEIVAQHTKEWSEMINTHSAEEQEIRDLHLSQQCELLKKLLINAHEQQTQQLKLSHDRESKEMRAHQAKISMENSKAISQDKSIKNKAERERRVRELNSSNTKKFLEERKRLAMKQSKEMDQLKKVQLEHLEFLEKQNEQAKEMQQMVKLEAEMDRRPATVV

SEQ ID NO: 57915 - protein, 60 aa, Homo sapiens
MAKPYEFNWQKEVPSFLQEGAVFDRYEEESFVFEPNCLFKVDEFGFFLTWRSEGKEGQVL

SEQ ID NO: 57916 - protein, 81 aa, Homo sapiens
MAKPYEFNWQKEVPSFLQEGAVFDRYEEESFVFEPNCLFKVDEFGFFLTWRSEGKEGQVLECSLINSIRSGAIPKDPKILA

SEQ ID NO: 57917 - protein, 110 aa, Homo sapiens
MAKPYEFNWQKEVPSFLQEGAVFDRYEEESFVFEPNCLFKVDEFGFFLTWRSEGKEGQVLECSLINSIRSGAIPKDPKILAALEAVGKSENDLEGRIVCVCSGTDLVNIS

SEQ ID NO: 57918 - protein, 756 aa, Homo sapiens
MDSGRDFLTLHGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 57919 - protein, 777 aa, Homo sapiens
MQCLGIRSRSRSRELYLQERSLKVAALNGRRLGLQDDEDLQALLKGSQLLKVKSSSWRRERFYKLQEDCKTIWQESRKVMRTPESQLFSIEDIQEVRMGHRTEGLEKFARDVPEDRCFSIVFKDQRNTLDLIAPSPADAQHWVLGLHKIIHHSGSMDQRQKLQHWIHSCLRKADKNKDNKMSFKELQNFLKELNIQVDDSYARKIFRECDHSQTDSLEDEEIEAFYKMLTQRVEIDRTFAEAAGSGETLSVDQLVTFLQHQQREEAAGPALALSLIERYEPSETAKAQRQMTKDGFLMYLLSADGSAFSLAHRRVYQDMGQPLSHYLVSSSHNTYLLEDQLAGPSSTEAYIRALCKGCRCLELDCWDGPNQEPIIYHGYTFTSKILFCDVLRAIRDYAFKASPYPVILSLENHCTLEQQRVMARHLHAILGPMLLNRPLDGVTNSLPSPEQLKGKILLKGKKLGGLLPPGGEGGPEATVVSDEDEAAEMEDEAVRSRVQHKPKEDKLRLAQELSDMVIYCKSVHFGGFSSPGTPGQAFYEMASFSENRALRLLQESGNGFVRHNVGHLSRIYPAGWRTDSSNYSPVEMWNGGCQIVALNFQTPGPEMDVYQGRFQDNGACGYVLKPAFLRDPNGTFNPRALAQGPWWARKRLNIRVISGQQLPKVNKNKNSIVDPKVTVEIHGVSRDVASRQTAVITNNGFNPWWDTEFAFEVVVPDLALIRFLVEDYDASSKNDFIGQSTIPLNSLKQGYRHVHLMSKNGDQHPSATLFVKISLQD

SEQ ID NO: 57920 - protein, 2302 aa, Homo sapiens
MTSEEMTASVLIPVTQRKVVSAQSAADESSEKVSDINISKAHTVRRSGETSHTISQLNKLKEEPSGSNLPKILSIAREKIVSDENSNEKCWEKIMPDSAKNLNINCNNILRNHQHGLPQRQFYEMYNSVAEEDLCLETGIPSPLERKVFPGIQLELDRPSMGISPLGNQSVIIETGRAHPDSRRAVFHFHYEVDRRMSDTFCTLSENLILDDCGNCVPLPGGEEKQKKNYVAYTCKLMELAKNCDNKNEQLQCDHCDTLNDKYFCFEGSCEKVDMVYSGDSFCRKDFTDSQAAKTFLSHFEDFPDNCDDVEEDAFKSKKERSTLLVRRFCKNDREVKKSVYTGTRAIVRTLPSGHIGLTAWSYIDQKRNGPLLPCGRVMEPPSTVEIRQDGSQRLSEAQWYPIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 57921 - protein, 1994 aa, Homo sapiens
MVSEGSAAGRDFAGMEEVRQLHVRFCKGIKIWHQAWFLCSLLGREPQEREAGCQLWLCTLSAVLKVGWLFPLSEVPNFTLLKDGCGCWRLKEDQIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQ

SEQ ID NO: 57922 - protein, 2312 aa, Homo sapiens
MTSEEMTASVLIPVTQRKVVSAQSAADESSEKVSDINISKAHTVRRSGETSHTISQLNKLKEEPSGSNLPKILSIAREKIVSDENSNEKCWEKIMPDSAKNLNINCNNILRNHQHGLPQRQFYEMYNSVAEEDLCLETGIPSPLERKVFPGIQLELDRPSMGISPLGNQSVIIETGRAHPDSRRAVFHFHYEVDRRMSDTFCTLSENLILDDCGNCVPLPGGEEKQKKNYVAYTCKLMELAKNCDNKNEQLQCDHCDTLNDKYFCFEGSCEKVDMVYSGDSFCRKDFTDSQAAKTFLSHFEDFPDNCDDVEEDAFKSKKERSTLLVRRFCKNDREVKKSVYTGTRAIVRTLPSGHIGLTAWSYIDQKRNGPLLPCGRVMEPPSTVEIRQDGSQRLSEAQWYPIYNAVRREETENTVGSLLHFLTKLPASETAHGRISVGPCLKQCVRDTVCEYRATLQRTSISQYITGSLLEATTSLGARSGLLSTFGGSTGRMMLKERQPGPSVANSNALPSSSAGISKELIDLQPLIQFPEEVASILMEQEQTIYRRVLPVDYLCFLTRDLGTPECQSSLPCLKASISASILTTQNGEHNALEDLVMRFNEVSSWVTWLILTAGSMEEKREVFSYLVHVAKCCWNMGNYNAVMEFLAGLRSRKVLKMWQFMDQSDIETMRSLKDAMAQHESSCEYRKVVTRALHIPGCKVVPFCGVFLKELCEVLDGASGLMKLCPRYNSQEETLEFVADYSGQDNFLQRVGQNGLKNSEKESTVNSIFQVIRSCNRSLETDEEDSPSEGNSSRKSSLKDKSRWQFIIGDLLDSDNDIFEQSKEYDSHGSEDSQKAFDHGTELIPWYVLSIQADVHQFLLQGATVIHYDQDTHLSARCFLQLQPDNSTLTWVKPTTASPASSKAKLGVLNNTAEPGKFPLLGNAGLSSLTEGVLDLFAVKAVYMGHPGIDIHTVCVQNKLGSMFLSETGVTLLYGLQTTDNRLLHFVAPKHTAKMLFSGLLELTRAVRKMRKFPDQRQQWLRKQYVSLYQEDGRYEGPTLAHAVELFGGRRWSARNPSPGTSAKNAEKPNMQRNNTLGISTTKKKKKILMRGESGEVTDDEMATRKAKMHKECRSRSGSDPQDINEQEESEVNAIANPPNPLPSRRAHSLTTAGSPNLAAGTSSPIRPVSSPVLSSSNKSPSSAWSSSSWHGRIKGGMKGFQSFMVSDSNMSFVEFVELFKSFSVRSRKDLKDLFDVYAVPCNRSGSESAPLYTNLTIDENTSDLQPDLDLLTRNVSDLGLFIKSKQQLSDNQRQISDAIAAASIVTNGTGIESTSLGIFGVGILQLNDFLVNCQGEHCTYDEILSIIQKFEPSISMCHQGLMSFEGFARFLMDKENFASKNDESQENIKELQLPLSYYYIESSHNTYLTGHQLKGESSVELYSQVLLQGCRSVELDCWDGDDGMPIIYHGHTLTTKIPFKEVVEAIDRSAFINSDLPIIISIENHCSLPQQRKMAEIFKTVFGEKLVTKFLFETDFSDDPMLPSPDQLRKKVLLKNKKLKAHQTPVDILKQKAHQLASMQVQAYNGGNANPRPANNEEEEDEEDEYDYDYESLSDDNILEDRPENKSCNDKLQFEYNEEIPKRIKKADNSACNKGKVYDMELGEEFYLDQNKKESRQIAPELSDLVIYCQAVKFPGLSTLNASGSSRGKERKSRKSIFGNNPGRMSPGETASFNKTSGKSSCEGIRQTWEESSSPLNPTTSLSAIIRTPKCYHISSLNENAAKRLCRRYSQKLTQHTACQLLRTYPAATRIDSSNPNPLMFWLHGIQLVALNYQTDDLPLHLNAAMFEANGGCGYVLKPPVLWDKNCPMYQKFSPLERDLDSMDPAVYSLTIVSGQNVCPSNSMGSPCIEVDVLGMPLDSCHFRTKPIHRNTLNPMWNEQFLFHVHFEDLVFLRFAVVENNSSAVTAQRIIPLKALKRGYRHLQLRNLHNEVLEISSLFINSRRMEENSSGNTMSASSMFNTEERKCLQTHRVTVHGVPGPEPFTVFTINGGTKAKQLLQQILTNEQDIKPVTTDYFLMEEKYFISKEKNECRKQPFQRAIGPEEEIMQILSSWFPEEGYMGRIVLKTQQENLEEKNIVQDDKEVILSSEEESFFVQVHDVSPEQPRTVIKAPRVSTAQDVIQQTLCKAKYSYSILSNPNPSDYVLLEEVVKDTTNKKTTTPKSSQRVLLDQECVFQAQSKWKGAGKFILKLKEQVQASREDKKKGISFASELKKLTKSTKQPRGLTSPSQLLTSESIQTKEEKPVGGLSSSDTMDYRQVKIFKQEVKE

SEQ ID NO: 57923 - protein, 1994 aa, Homo sapiens; identical to SEQ ID NO: 57921

SEQ ID NO: 57924 - protein, 1655 aa, Homo sapiens
MSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLAEDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 57925 - protein, 1693 aa, Homo sapiens
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLAEDKDGRRKGKASIKDPHFLNFNKKLSSSSSALLHKDTSQGDTIVSTAHMSVTGEQLGMSSPRGGRTTSNATSNCQENPCPSKSLSPKQHLAPDPVVNPTQDLHGVKIKEKGNPEDFVEGKSILSGSVLSHSNLEIKNLEGNRGKGRAATSFSLSDVSMLCSDIPDLHSTAILQESVISHLIDNVTLTNENEPGSSISALIGQFDETNNQALTVVSHLHNTSVMSGHCPLPSLGLKMPIKHGFCKGKSKSSFLCSSPELIALSSSETTKHATNTVYETTCTPISKTKPDDDLSSKAKTAALESNLPGSPNTSRGWLPKSPTKGEDWETLKSCSPASSPDLTLEDVIADPTLCFNSGESSLVEIDGESENLSLTTCEYRREGTSQLASPLKLKYNQGVVEHFQRGLRNGYCKETLRPSVPEIFNNIQDVKTQSISYLAYQGAGFVHNHFSDSDAKMFQTCVPQQSSAQDMHVPVPKQLAHLPLPALKLPSPCKSKSLGDLTSEDIACNFESKYQCISKSFVTTGIRDKKGVTVKTKSLEPIDALTEQLRKLVSFDQEDNCQVLYSKQDANQLPRALVRKLSSRSQSRVRNIASRAKEKQEANKQKVPNPSNGAGVVLRNKPSAPTPAVNRHSTGSYIAGYLKNTKGGGLEGRGIPEGACTALHYGHVDQFCSDNSVLQTEPSSDDKPEIYFLLRL

SEQ ID NO: 57926 - protein, 1655 aa, Homo sapiens; identical to SEQ ID NO: 57924

SEQ ID NO: 57927 - protein, 1002 aa, Homo sapiens
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKWSPLILNPSYTILHFLGATKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLVQI

SEQ ID NO: 57928 - protein, 1655 aa, Homo sapiens; identical to SEQ ID NO: 57924

SEQ ID NO: 57929 - protein, 1014 aa, Homo sapiens
MADLEVYKNLSPEKVERCMSVMQSGTQMIKLKRGTKGLVRLFYLDEHRTRLRWRPSRKSEKAKILIDSIYKVTEGRQSEIFHRQAEGNFDPSCCFTIYHGNHMESLDLITSNPEEARTWITGLKYLMAGISDEDSLAKRQRTHDQWVKQTFEEADKNGDGLLNIEEIHQLMHKLNVNLPRRKVRQMFQEADTDENQGTLTFEEFCVFYKMMSLRRDLYLLLLSYSDKKDHLTVEELAQFLKVEQKMNNVTTDYCLDIIKKFEVSEENKVKNVLGIEGFTNFMRSPACDIFNPLHHEVYQDMDQPLCNYYIASSHNTYLTGDQLLSQSKVDMYARVLQEGCRCVEVDCWDGPDGEPVVHHGYTLTSKILFRDVVETINKHAFVKNEFPVILSIENHCSIQQQRKIAQYLKGIFGDKLDLSSVDTGECKQLPSPQSLKGKILVKGKKLPYHLGDDAEEGEVSDEDSADEIEDECKFKLHYSNGTTEHQVESFIRKKLESLLKESQIRDKEDPDSFTVRALLKATHEGLNAHLKQSPDVKESGKKSHGRSLMTNFGKHKKTTKSRSKSYSTDDEEDTQQSTGKEGGQLYRLGRRRKTMKLCRELSDLVVYTNSVAAQDIVDDGTTGNVLSFSETRAHQVVQQKSEQFMIYNQKQLTRIYPSAYRIDSSNFNPLPYWNAGCQLVALNYQSEGRMMQLNRAKFKANGNCGYVLKPQQMCKGTFNPFSGDPLPANPKKQLILKVISGQQLPKPPDSMFGDRGEIIDPFVEVEIIGLPVDCCKDQTRVVDDNGFNPVWEETLTFTVHMPEIALVRFLVWDHDPIGRDFVGQRTVTFSSLVPGYRHVYLEGLTEASIFVHITINEIYGKNRQLQGLKGLFNKNPRHSSSENNSHYVRKRSIGDRILRRTASAPAKGRKKSKMGFQEMVEIKDSVSEATRDQDGVLRRTTRSLQARPVSMPVDRNLLGALSLPVSETAKDIEGKENSLDSSFCRPTEQAKAEMCKVPFPRQLECVMKMEISET

SEQ ID NO: 57930 - protein, 1168 aa, Homo sapiens
MFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 57931 - protein, 499 aa, Homo sapiens
MGAMQEGMQMVKLRGGSKGLVRFYYLDEHRSCIRWRPSRKNEKAKISIDSIQEVSEGRQSEVFQRYPDGSFIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAGKPLLPCVVLPHAPGMAGPGSPAAASAWTVSPRVLVLVALYPWHCLRGTLLPWLACGP

SEQ ID NO: 57932 - protein, 1058 aa, Homo sapiens
MAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAGKPLLPCVVLPHAPGMAGPGSPAAASAWTVSPRVLVLVALYPWHCLRGTLLPWLACGP

SEQ ID NO: 57933 - protein, 497 aa, Homo sapiens
MGAMQEGMQMVKLRGGSKGLVRFYYLDEHRSCIRWRPSRKNEKAKISIDSIQEVSEGRQSEVFQRYPDGSFDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAGKPLLPCVVLPHAPGMAGPGSPAAASAWTVSPRVLVLVALYPWHCLRGTLLPWLACGP

SEQ ID NO: 57934 - protein, 1416 aa, Homo sapiens
MSGPWPSPDSRTKGTVAWLAEVLLWVGGSVVLSSEWQLGPLVERCMGAMQEGMQMVKLRGGSKGLVRFYYLDEHRSCIRWRPSRKNEKAKISIDSIQEVSEGRQSEVFQRYPDGSFDPNCCFSIYHGSHRESLDLVSTSSEVARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 57935 - protein, 1380 aa, Homo sapiens
MSGPWPSPDSRTKGTVAWLAEVLLWVGGSVVLSSEWQLGPLVERCMGAMQEGMQMVKLRGGSKGLVRFYYLDEHRSCIRWRPSRKNEKAKISIDSIQEVSEGRQSEVFQRYPDGSFDPNCCFSIYHGSHRESLDLVSTSSEVARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 57936 - protein, 711 aa, Homo sapiens
  MOD_RES (1)..(1): Any amino acid
XALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRDTRPLSTQRPLPPLCSLETIAEEPAPGPGPPPPAAVPTSSSQGRPPYPTGPGANVASPLEDTEEPRDSRPRPCNGEGAGGAYERAPGSQTDGRSQPRTLGHLPVIRRVKSEGQVPTEPLGGWRPLAAPFPAPAVYSDATGSDPLWQRLEPCGHRDSVSSSSSMSSSDTVIDLSLPSLGLGRSRENLAGAHMGRLPPRPHSASAARPDLPPVTKSKSNPNLRATGQRPPIPDELQPRSLAPRMAGLPFRPPWGCLSLVGVQDCPVAAKSKSLGDLTADDFAPSFEGGSRRLSHSLGLPGGTRRVSGPGVRRDTLTEQLRWLTVFQQAGDITSPTSLGPAGEGVAGGPGFVRRSSSRSHSRVRAIASRARQAQERQQRLQGLGRQGPPEEERGTPEGACSVGHEGSVDAPAPSKGALGPASAAAENLVLLRL

SEQ ID NO: 57937 - protein, 1129 aa, Homo sapiens
MEEPGPPGGLSQDQVERCMGAMQEGMQMVKLRGGSKGLVRFYYLDEHRSCIRWRPSRKNEKAKISIDSIQEVSEGRQSEVFQRYPDGSFDPNCCFSIYHGSHRESLDLVSTSSEVARTWVTGLRYLMAGISDEDSLARRQRTRDQWLKQTFDEADKNGDGSLSIGEVLQLLHKLNVNLPRQRVKQMFREADTDDHQGTLGFEEFCAFYKMMSTRRDLYLLMLTYSNHKDHLDAASLQRFLQVEQKMAGVTLESCQDIIEQFEPCPENKSKGLLGIDGFTNYTRSPAGDIFNPEHHHVHQDMTQPLSHYFITSSHNTYLVGDQLMSQSRVDMYAWVLQAGCRCVEVDCWDGPDGEPIVHHGYTLTSKILFKDVIETINKYAFIKNEYPVILSIENHCSVIQQKKMAQYLTDILGDKLDLSSVSSEDATTLPSPQMLKGKILVKGKKLPANISEDAEEGEVSDEDSADEIDDDCKLLNGDASTNRKRVENTAKRKLDSLIKESKIRDCEDPNNFSVSTLSPSGKLGRKSKAEEDVESGEDAGASRRNGRLVVGSFSRRKKKGSKLKKAASVEEGDEGQDSPGGQSRGATRQKKTMKLSRALSDLVKYTKSVATHDIEMEAASSWQVSSFSETKAHQILQQKPAQYLRFNQQQLSRIYPSSYRVDSSNYNPQPFWNAGCQMVALNYQSEGRMLQLNRAKFSANGGCGYVLKPGCMCQGVFNPNSEDPLPGQLKKQLVLRIISGQQLPKPRDSMLGDRGEIIDPFVEVEIIGLPVDCSREQTRVVDDNGFNPTWEETLVFMVHMPEIALVRFLVWDHDPIGRDFIGQRTLAFSSMMPGYRHVYLEGMEEASIFVHVAVSDISGKVKQALGLKGLFLRGPKPGSLDSHAAGRPPARPSVSQRILRRTASAPTKSQKPGRRGFPELVLGTRDTGSKGVADDVVPPGPGPAPEAPAQEGPGSGSPRGKAPAAVAEKSPVRVRPPRVLDGPGPAGMAATCMKCVVGSCAGVNTGGLQRERPPSPGPASRQAAIRQQPRARADSLGAPCCGLDPHAIPGRSREAPKGPGAWRQGPGGSGSMSSDSSSPDSPGIPERSPRWPEGACRQPGALQGEMSALFAQKLEEIRSKSPMFSAVRN

SEQ ID NO: 57938 - protein, 608 aa, Homo sapiens
MEMRWFLSKIQDDFRGGKINLEKTQRLLEKLDIRCSYIHVKQIFKDNDRLKQGRITIEEFRAIYRIITHREEIIEIFNTYSENRKILLASNLAQFLTQEQYAAEMSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 57939 - protein, 413 aa, Homo sapiens
MRWFLSKIQDDFRGGKINLEKTQRLLEKLDIRCSYIHVKQIFKTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 57940 - protein, 606 aa, Homo sapiens
MRWFLSKIQDDFRGGKINLEKTQRLLEKLDIRCSYIHVKQIFKDNDRLKQGRITIEEFRAIYRIITHREEIIEIFNTYSENRKILLASNLAQFLTQEQYAAEMSKAIAFEIIQKYEPIEEVRKAHQMSLEGFTRYMDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 57941 - protein, 415 aa, Homo sapiens
MEMRWFLSKIQDDFRGGKINLEKTQRLLEKLDIRCSYIHVKQIFKTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNAFSPRWNETFTFIIHVPELALIRFVVEGQGLIAGNEFLGQYTLPLLCMNKGYRRIPLFSRMGESLEPASLFVYVWYVR

SEQ ID NO: 57942 - protein, 403 aa, Homo sapiens
MDSRECLLFKNECRKVYQDMTHPLNDYFISSSHNTYLVSDQLLGPSDLWGYVSALVKGCRCLEIDCWDGAQNEPVVYHGYTLTSKLLFKTVIQAIHKYAFMTSDYPVVLSLENHCSTAQQEVMADNLQATFGESLLSDMLDDFPDTLPSPEALKFKILVKNKKIGTLKETHERKGSDKRGDNQDKETGVKKLPGVMLFKKKKTRKLKIALALSDLVIYTKAEKFKSFQHSRLYQQFNENNSIGETQARKLSKLRVHEFIFHTRKFITRIYPKATRADSSNFNPQEFWNIGCQMVALNFQTPGLPMDLQNGKFLDNGGSGYILKPHFLRESKSYFNPSNIKEGMPITLTIRLISGIQLPLTHSSSNKGDSLVIIEVFGVPNDQMKQQTRVIKKNGQGNMVIIPA

SEQ ID NO: 57943 - protein, 1128 aa, Homo sapiens
MADCVRGWAAVGGALPTSPGPSLGAKGALKAGVGEDGVGGGRLVHGRARYDSGGVSNGDCSLGVSGDEARASPTRGPRGVALAPTPSAVVCTLPRESKPGGLPRRSSIIKDGTKQKRERKKTVSFSSMPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 57944 - protein, 960 aa, Homo sapiens
MPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKIRKTGRRSIFVPQTPIMV

SEQ ID NO: 57945 - protein, 1001 aa, Homo sapiens
MPTEKKISSASDCINSMVEGSELKKVRSNSRIYHRYFLLDADMQSLRWEPSKKDSEKAKIDIKSIKEVRTGKNTDIFRSNGISDQISEDCAFSVIYGENYESLDLVANSADVANIWVTGLRYLISYGKHTLDMLESSQDNMRTSWVSQMFSEIDVDNLGHITLCNAVQCIRNLNPGLKTSKIELKFKELHKSKDKAGTEVTKEEFIEVFHELCTRPEIYFLLVQFSSNKEFLDTKDLMMFLEAEQGVAHINEEISLEIIHKYEPSKEGQEKGWLSIDGFTNYLMSPDCYIFDPEHKKVCQDMKQPLSHYFINSSHNTYLIEDQFRGPSDITGYIRALKMGCRSVELDVWDGPDNEPVIYTGHTMTSQIVFRSVIDIINKYAFFASEYPLILCLENHCSIKQQKVMVQHMKKLLGDKLYTTSPNVEESYLPSPDVLKGKILIKAKKLSSNCSGVEGDVTDEDEGAEMSQRMGKENMEQPNNVPVKRFQLCKELSELVSICKSVQFKEFQVSFQVQKYWEVCSFNEVLASKYANENPGDFVNYNKRFLARVFPSPMRIDSSNMNPQDFWKCGCQIVAMNFQTPGLMMDLNIGWFRQNGNCGYVLRPAIMREEVSFFSANTKDSVPGVSPQLLHIKIISGQNFPKPKGSGAKGDVVDPYVYVEIHGIPADCAEQRTKTVHQNGDAPIFDESFEFQINLPELAMVRFVVLDDDYIGDEFIGQYTIPFECLQTGYRHVPLQSLTGEVLAHASLFVHVAITNRRGGGKPHKRGLSVRKGKKSREYASLRTLWIKTVDEVFKNAQPPIRDATDLRENMQNAVVSFKELCGLSSVANLMQCMLAVSPRFLGPDNTPLVVLNLSEQYPTMELQGIVPEVLKKIVTTYDMMIQSLKALIENADAVYEKIVHCQKAAMEFHEHLHSIGTKEGLKERKLQKAVESFTWNITILKGQADLLKYAKNETLENLKQIHFAAVSCGLNKPGTENADVQKPRRSLEVIPEKANDETGE

SEQ ID NO: 57946 - protein, 1001 aa, Homo sapiens; identical to SEQ ID NO: 57945

SEQ ID NO: 57947 - protein, 933 aa, Homo sapiens
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGRFALSLRKHCFGVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 57948 - protein, 922 aa, Homo sapiens
MTATPESLFPTGDELDSSQLQMESDEVDTLKEGEDPADRMHPFLAIYELQSLKVHPLVFAPGVPVTAQVVGTERYTSGSKVGTCTLYSVRLTHGDFSWTTKKKYRHFQELHRDLLRHKVLMSLLPLARFAVAYSPARDAGNREMPSLPRAGPEGSTRHAASKQKYLENYLNRLLTMSFYRNYHAMTEFLEVSQLSFIPDLGRKGLEGMIRKRSGGHRVPGLTCCGRDQVCYRWSKRWLVVKDSFLLYMCLETGAISFVQLFDPGFEVQVGKRSTEARHGVRIDTSHRSLILKCSSYRQARWWAQEITELAQGPGRDFLQLHRHDSYAPPRPGTLARWFVNGAGYFAAVADAILRAQEEIFITDWWLSPEVYLKRPAHSDDWRLDIMLKRKAEEGVRVSILLFKEVELALGINSGYSKRALMLLHPNIKVMRHPDQVTLWAHHEKLLVVDQVVAFLGGLDLAYGRWDDLHYRLTDLGDSSESAASQPPTPRPDSPATPDLSHNQFFWLGKDYSNLITKDWVQLDRPFEDFIDRETTPRMPWRDVGVVVHGLPARDLARHFIQRWNFTKTTKAKYKTPTYPYLLPKSTSTANQLPFTLPGGQCTTVQVLRSVDRWSAGTLENSILNAYLHTIRESQHFLYIENQFFISCSDGRTVLNKVGDEIVDRILKAHKQGWCYRVYVLLPLLPGFEGDISTGGGNSIQAILHFTYRTLCRGEYSILHRLKAAMGTAWRDYISICGLRTHGELGGHPVSELIYIHSKVLIADDRTVIIGSANINDRSLLGKRDSELAVLIEDTETEPSLMNGAEYQAGSVILGANTRPDLDLRDPICDDFFQLWQDMAESNANIYEQIFRCLPSNATRSLRTLREYVAVEPLATVSPPLARSELTQVQGHLVHFPLKFLEDESLLPPLGSKEGMIPLEVWT

SEQ ID NO: 57949 - protein, 318 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKSLDEQCVVGKISKHWTGILREAFTDADNFGIQFPLDLDVKMKAVMIGACFLIDFMFFESTGSQEQKSGVW

SEQ ID NO: 57950 - protein, 30 aa, Homo sapiens
MKAVMIGACFLIDFMFFESTGSQEQKSGVW

SEQ ID NO: 57951 - protein, 249 aa, Homo sapiens
MDKQNSQMNASHPETNLPVGYPPQYPPTAFQGPPGYSGYPGPQVSYPPPPAGHSGPGPAGFPVPNQPVYNQPVYNQPVGAAGVPWMPAPQPPLNCPPGLEYLSQIDQILIHQQIELLEVLTGFETNNKYEIKNSFGQRVYFAAEDTDCCTRNCCGPSRPFTLRIIDNMGQEVITLERPLRCSSCCCPCCLQEIEIQAPPGVPIGYVIQTWHPCLPKFTIQNEKREDVLKISGPCVVCSCCGDVDFEIKS

SEQ ID NO: 57952 - protein, 224 aa, Homo sapiens
MPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFEITSLDEQIVVGRISKHWSGFLREAFTDADNFGIQFPRDLDVKMKAVMIGACFLIDYMFFERTR

SEQ ID NO: 57953 - protein, 161 aa, Homo sapiens
MPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFE

SEQ ID NO: 57954 - protein, 297 aa, Homo sapiens
MRSWNSLFCLNSSRPPGHIVYPKHQAGHTGKQADHLGSQAFYPGRQHDYLVPPAGTAGIPVQNQPGRPEGVPWMPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFEITSLDEQIVVGRISKHWSGFLREAFTDADNFGIQFPRDLDVKMKAVMIGACFLIDYMFFERTR

SEQ ID NO: 57955 - protein, 316 aa, Homo sapiens
VSAHLRFFLAIILRDSGLWAEWRMKPFQIHLPGPPGHIVYPKHQAGHTGKQADHLGSQAFYPGRQHDYLVPPAGTAGIPVQNQPGRPEGVPWMPAPPPPLNCPPGLEYLSQIDMILIHQQIELLEVLFSFESSNMYEIKNSFGQRIYFAAEDTNFCIRNCCGRSRPFTLRITDNVGREVITLERPLRCNCCCCPCCLQEIEIQAPPGVPVGYVTQTWHPCLTKFTIKNQKREDVLKISGPCIVCSCIAGVDFEITSLDEQIVVGRISKHWSGFLREAFTDADNFGIQFPRDLDVKMKAVMIGACFLIDYMFFERTR

SEQ ID NO: 57956 - protein, 295 aa, Homo sapiens
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWETCNRYELRSGAGQPLGQAAEESNCCARLCCGARRPLRVRLADPGDREVLRLLRPLHCGCSCCPCGLQEMEVQAPPGTTIGHVLQTWHPFLPKFSIQDADRQTVLRVVGPCWTCGCGTDTNFEVKTRDESRSVGRISKQWGGLVREALTDADDFGLQFPLDLDVRVKAVLLGATFLIDYMFFEKRGGAGPSAVTS

SEQ ID NO: 57957 - protein, 223 aa, Homo sapiens
MAGYLPPKGYAPSPPPPYPVTPGYPEPALHPGPGQAPVPAQVPAPAPGFALFPSPGPVALGSAAPFLPLPGVPSGLEFLVQIDQILIHQKAERVETFLGWRPVIGMNCALGPGSPWVRRPRRATAAPVCAVAPAGRCVSAWPTPGTVRCCVCSARCTVAAAAAPVASRRWKYRLHQAPPLATCYRPGIPSSPSSPSRMPIARQSCEWWGPAGPVAVAQTPTLR

SEQ ID NO: 57958 - protein, 295 aa, Homo sapiens; identical to SEQ ID NO: 57956

SEQ ID NO: 57959 - protein, 295 aa, Homo sapiens; identical to SEQ ID NO: 57956

SEQ ID NO: 57960 - protein, 329 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 57961 - protein, 239 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 57962 - protein, 329 aa, Homo sapiens; identical to SEQ ID NO: 57960

SEQ ID NO: 57963 - protein, 262 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQELEVQCPPGVTIGFVAEHWNLCRAVYSIQNEKKENVMRVRGPCSTYGCGSDSVFE

SEQ ID NO: 57964 - protein, 208 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNRYDIKNNSDQMVYIVTEDTDDFTRNAYRTLRPFVLRVTDCMGREIMTMQRPFRCTCCCFCCPSARQE

SEQ ID NO: 57965 - protein, 142 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLDNIHVLQHFEPLEMMTCFETNNR

SEQ ID NO: 57966 - protein, 329 aa, Homo sapiens; identical to SEQ ID NO: 57960

SEQ ID NO: 57967 - protein, 98 aa, Homo sapiens
MSGVVPTAPEQPAGEMENQTKPPDPRPDAPPEYNSHFLPGPPGTAVPPPTGYPGGLPMGYYSPQQPSTFPLYQPVGGIHPVRYQPGKYPMPNQSVPIT

SEQ ID NO: 57968 - protein, 224 aa, Homo sapiens
MENQTKPPDPRPDAPPEYNSHFLPGPPGTAVPPPTGYPGGLPMGYYSPQQPSTFPLYQPVGGIHPVRYQPGKYPMPNQSVPITWMPGPTPMANCPPGLEYLVQLEVQCPPGVTIGFVAEHWNLCRAVYSIQNEKKENVMRVRGPCSTYGCGSDSVFEVKSLDGISNIGSIIRKWNGLLSAMADADHFDIHFPLDLDVKMKAMIFGACFLIDFMYFERSPPQRSR

SEQ ID NO: 57969 - protein, 441 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFLKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 57970 - protein, 493 aa, Homo sapiens
MALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 57971 - protein, 493 aa, Homo sapiens; identical to SEQ ID NO: 57970

SEQ ID NO: 57972 - protein, 513 aa, Homo sapiens
MGLSGSDNSCDPTPPPGPLAMALFGALFLALLAGAHAEFPGCKIRVTSKALELVKQEGLRFLEQELETITIPDLRGKEGHFYYNISEVKVTELQLTSSELDFQPQQELMLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 57973 - protein, 405 aa, Homo sapiens
MLQITNASLGLRFRRQLLYWFFYDGGYINASAEGVSIRTGLELSRDPAGRMKVSNVSCQASVSRMHAAFGGTFKKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 57974 - protein, 398 aa, Homo sapiens
MALFGALFLALLAGAHAEFPGCKIRVTSKALELVKQEGLRFLEQELETITIPDLRGKEGHFYYNISEKVYDFLSTFITSGMRFLLNQQICPVLYHAGTVLLNSLLDTVPVRSSVDELVGIDYSLMKDPVASTSNLDMDFRGAFFPLTERNWSLPNRAVEPQLQEEERMVYVAFSEFFFDSAMESYFRAGALQLLLVGDKVPHDLDMLLRATYFGSIVLLSPAVIDSPLKLELRVLAPPRCTIKPSGTTISVTASVTIALVPPDQPEVQLSSMTMDARLSAKMALRGKALRTQLDLRRFRIYSNHSALESLALIPLQAPLKTMLQIGVMPMLNERTWRGVQIPLPEGINFVHEVVTNHAGFLTIGADLHFAKGLREVIEKNRPADVRASTAPTPSTAAV

SEQ ID NO: 57975 - protein, 262 aa, Homo sapiens
MAVTAQAARRKERVLCLFDVDGTLTPARQKIDPEVAAFLQKLRSRVQIGVVGGSDYCKIAEQLGDGDEVIEKFDYVFAENGTVQYKHGRLLSKQTIQNHLGEELLQDLINFCLSYMALLRLPKKRGTFIEFRNGMLNISPIGRSCTLEERIEFSELDKKEKIREKFVEALKTEFAGKGLRFSRGGMISFDVFPEGWDKRYCLDSLDQDSFDTIHFFGNETSPGGNDFEIFADPRTVGHSVVSPQDTVQRCREIFFPETAHEA

SEQ ID NO: 57976 - protein, 246 aa, Homo sapiens
MAAPGPALCLFDVDGTLTAPRQKITKEMDDFLQKLRQKIKIGVVGGSDFEKVQEQLGNDVVEKYDYVFPENGLVAYKDGKLLCRQNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 57977 - protein, 121 aa, Homo sapiens
MLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 57978 - protein, 163 aa, Homo sapiens
MMNIQSHLGEALIQDLINYCLSYIAKIKLPKKRGTFIEFRNGMLNVSPIGRSCSQEERIEFYELDKKENIRQKFVADLRKEFAGKGLTFSIGGQISFDVFPDGWDKRYCLRHVENDGYKTIYFFGDKTMPGGNDHEIFTDPRTMGYSVTAPEDTRRICELLFS

SEQ ID NO: 57979 - protein, 192 aa, Homo sapiens
MAPLGGAPRLVLLFSGKRKSGKDFVTEALQSRLGADVCAVLRLSGPLKEQYAQEHGLNFQRLLDTSTYKEAFRKDMIRWGEEKRQADPGFFCRKIVEGISQPIWLVSDTRRVSDIQWFREAYGAVTQTVRVVALEQSRQQRGWVFTPGVDDAESECGLDNFGDFDWVIENHGVEQRLEEQLENLIEFIRSRL

SEQ ID NO: 57980 - protein, 204 aa, Homo sapiens
MEPKASCPAAAPLMERKFHVLVGVTGSVAALKLPLLVSKLLDIPGLEVAVVTTERAKHFYSPQDIPVTLYSDADEWEIWKSRSDPVLHIDLRRWADLLLVAPLDANTLGKVASGICDNLLTCVMRAWDRSKPLLFCPAMNTAMWEHPITAQQVDQLKAFGYVEIPCVAKKLVCGDEGLGAMAEVGTIVDKVKEVLFQHSGFQQS

SEQ ID NO: 57981 - protein, 56 aa, Homo sapiens
MAEMDPVAEFPQPPGAARWAEALLRCFTWLRLCQISMFLSLKCLNTRSSHLGAHCR

SEQ ID NO: 57982 - protein, 213 aa, Homo sapiens
MAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGPSAMFYLAAAVSDFYVPVSEMPEHKIQSSGGPLQVMGASLPEI

SEQ ID NO: 57983 - protein, 311 aa, Homo sapiens
MAEMDPVAEFPQPPGAARWAEVMARFAARLGAQGRRVVLVTSGGTKVPLEARPVRFLDNFSSGRRGATSAEAFLAAGYGVLFLYRARSAFPYAHRFPPQTWLSALRPSGPALSGLLSLEAEENALPGFAEALRSYQEAAAAGTFLAVEFTTLADYLHLLQAAAQALNPLGPSAMFYLAAAVSDFYVPVSEMPEHKIQSSGGPLQITMKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 57984 - protein, 138 aa, Homo sapiens
MFYLAAAVSDFYVPVSEMPEHKIQSSGGPLQITMKMVPKLLSPLVKDWAPKAFIISFKLETDPAIVINRARKALEIYQHQVVVANILESRQSFVFIVTKDSETKLLLSEEEIEKGVEIEEKIVDNLQSRHTAFIGDRN

SEQ ID NO: 57985 - protein, 138 aa, Homo sapiens; identical to SEQ ID NO: 57984

SEQ ID NO: 57986 - protein, 130 aa, Homo sapiens
MAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 57987 - protein, 151 aa, Homo sapiens
MEDEGNKLCQAPPWPGQTSPVMAEYGTLLQDLTNNITLEDLEQLKSACKEDIPSEKSEEITTGSAWFSFLESHNKLDKDNLSYIEHIFEISRRPDLLTMVVDYRTRVLKISEEDELDTKLTRIPSAKKYKDIIRQPSEEEIIKLAPPPKKA

SEQ ID NO: 57988 - protein, 108 aa, Homo sapiens
MAEYGTLLQDLTNNITLEDLEQLKSACKEDIPSEKNNLSYIEHIFEISRRPDLLTMVVDYRTRVLKISEEDELDTKLTRIPSAKKYKDIIRQPSEEEIIKLAPPPKKA

SEQ ID NO: 57989 - protein, 517 aa, Homo sapiens
MELEELGIREECGVFGCIASGEWPTQLDVPHVITLGLVGLQHRGQESAGIVTSDGSSVPTFKSHKGMGLVNHVFTEDNLKKLYVSNLGIGHTRYATTGKCELENCQPFVVETLHGKIAVAHNGELVNAARLRKKLLRHGIGLSTSSDSEMITQLLAYTPPQEQDDTPDWVARIKNLMKEAPTAYSLLIMHRDVIYAVRDPYGNRPLCIGRLIPVSDINDKEKKTSETEGWVVSSESCSFLSIGARYYREVLPGEIVEISRHNVQTLDIISRSEGNPVAFCIFEYVYFARPDSMFEDQMVYTVRYRCGQQLAIEAPVDADLVSTVPESATPAALAYAGKCGLPYVEVLCKNRYVGRTFIQPNMRLRQLGVAKKFGVLSDNFKGKRIVLVDDSIVRGNTISPIIKLLKESGAKEVHIRVASPPIKYPCFMGINIPTKEELIANKPEFDHLAEYLGANSVVYLSVEGLVSSVQEGIKFKKQKEKKHDIMIQENGNGLECFEKSGHCTACLTGKYPVELEW

SEQ ID NO: 57990 - protein, 218 aa, Homo sapiens
MELLIMINACKIASASRVTAVIPCFPYARQDKKDKGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 57991 - protein, 168 aa, Homo sapiens
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQVSVEAKYWCLKGGRKGLMMLKTAEKPKIMPKYI

SEQ ID NO: 57992 - protein, 251 aa, Homo sapiens
MELLIMINACKIASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 57993 - protein, 318 aa, Homo sapiens
MPNIKIFSGSSHQDLSQKIADRLGLELGKVVTKKFSNQETCVEIGESVRGEDVYIVQSGCGEINDNLMELLIMINACKIASASRVTAVIPCFPYARQDKKDKSRAPISAKLVANMLSVAGADHIITMDLHASQIQGFFDIPVDNLYAEPAVLKWIRENISEWRNCTIVSPDAGGAKRVTSIADRLNVDFALIHKERKKANEVDRMVLVGDVKDRVAILVDDMADTCGTICHAADKLLSAGATRVYAILTHGIFSGPAISRINNACFEAVVVTNTIPQEDKMKHCSKIQVIDISMILAEAIRRTHNGESVSYLFSHVPL

SEQ ID NO: 57994 - protein, 318 aa, Homo sapiens; identical to SEQ ID NO: 57993

SEQ ID NO: 57995 - protein, 318 aa, Homo sapiens
TPNIKIFSGSSHQDLSQKIADRLGLELGKVVTKKFSNQETCVEIDESVRGEDVYIVQSGCGEINDSLMELLIMINACKIASASRVTAVIPCFPYARQDKKDKSRSPISAKLVANMLSIAGADHIITMDLHASQIQGFFDIPVDNLYAEPTVLKWIRENIPEWKNCIIVSPDAGGAKRVTSIADQLNVDFALIHKERKKANEVDCIVLVGDVNDRVAILVDDMADTCVTICLAADKLLSAGATRVYAILTHGIFSGPAISRINTACFEAVVVTNTIPQDEKMKHCSKIRVIDISMILAEAIRRTHNGESVSYLFSHVPL

SEQ ID NO: 57996 - protein, 318 aa, Homo sapiens
MPNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKSRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 57997 - protein, 321 aa, Homo sapiens
MPNIVLFSGSSHQDLSQRVADRLGLELGKVVTKKFSNQETSVEIGESVRGEDVYIIQSGCGEINDNLMELLIMINACKIASSSRVTAVIPCFPYARQDKKDKVGESRAPISAKLVANMLSVAGADHIITMDLHASQIQGFFDIPVDNLYAEPAVLQWIRENIAEWKNCIIVSPDAGGAKRVTSIADRLNVEFALIHKERKKANEVDRMVLVGDVKDRVAILVDDMADTCGTICHAADKLLSAGATKVYAILTHGIFSGPAISRINNAAFEAVVVTNTIPQEDKMKHCTKIQVIDISMILAEAIRRTHNGESVSYLFSHVPL

SEQ ID NO: 57998 - protein, 282 aa, Homo sapiens
MELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 57999 - protein, 385 aa, Homo sapiens
MPKKLLLLPPPSASSAFRVPRARPVPPPAMNAARTGYRVFSANSTAACTELAKRITERLGAELGKSVVYQETNGETRVEIKESVRGQDIFIIQTIPRDVNTAVMELLIMAYALKTACARNIIGVIPYFPYSKQSKMRKRGSIVCKLLASMLAKAGLTHIITMDLHQKEIQGFFSFPVDNLRASPFLLQYIQEEIPNYRNAVIVAKSPDAAKRAQSYAERLRLGLAVIHGEAQCTELDMDDGRHSPPMVKNATVHPGLELPLMMAKEKPPITVVGDVGGRIAIIVDDIIDDVESFVAAAEILKERGAYKIYVMATHGILSAEAPRLIEESSVDEVVVTNTVPHEVQKLQCPKIKTVDISLILSEAIRRIHNGESMAYLFRNITVDD

SEQ ID NO: 58000 - protein, 369 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 58001 - protein, 369 aa, Homo sapiens; identical to SEQ ID NO: 58000

SEQ ID NO: 58002 - protein, 268 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIV

SEQ ID NO: 58003 - protein, 194 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAK

SEQ ID NO: 58004 - protein, 329 aa, Homo sapiens
MFCVTPPELETKMNITKGGLVLFSANSNSSCMELSKKIAEDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 58005 - protein, 176 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEE

SEQ ID NO: 58006 - protein, 244 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIP

SEQ ID NO: 58007 - protein, 44 aa, Homo sapiens
MFCVTPPELETKMNITKGGLVLFSANSNSSCMELSKKIAERLGV

SEQ ID NO: 58008 - protein, 268 aa, Homo sapiens; identical to SEQ ID NO: 58002

SEQ ID NO: 58009 - protein, 140 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLT

SEQ ID NO: 58010 - protein, 268 aa, Homo sapiens; identical to SEQ ID NO: 58002

SEQ ID NO: 58011 - protein, 283 aa, Homo sapiens
MELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVDDIIDDVDSFLAAAETLKERGAYKIFVMATHGLLSSDAPRRIEESAIDEVVVTNTIPHEVQKLQCPKIKTVDISMILSEAIRRIHNGESMSYLFRNIGLDD

SEQ ID NO: 58012 - protein, 320 aa, Homo sapiens
MFCVTPPELETKMNITKGGLVLFSANSNSSCMELSKKIAERLGVEMGKVQVYQEPNRETRVQIQESVRGKDVFIIQTVSKDVNTTIMELLIMVYACKTSCAKSIIGVIPYFPYSKQCKMRKRGSIVSKLLASMMCKAGLTHLITMDLHQKEIQGFFNIPVDNLRASPFLLQYIQEEIPDYRNAVIVAKSPASAKRAQSFAERLRLGIAVIHGEAQDAESDLVDGRHSPPMVRSVAAIHPSLEIPMLIPKEKPPITVVGDVGGRIAIIVVVVTNTIPHEVQKLQCPKIKTVDISMILSEAIRRIHNGESMSYLFRNIGLDD

SEQ ID NO: 58013 - protein, 78 aa, Homo sapiens
MFCVTPPELETKMNITKGGLVLFSANSNSSCMELSKKIAENKSTNSRVCEGKRCFHHPNCFEGREHHHHGAPDHGVCM

SEQ ID NO: 58014 - protein, 225 aa, Homo sapiens
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKNVLIVEDVVGTGRTMKALLSNIEKYKPNMIKVASLLVKRTSRSDGFRPDYAGFEIPNLFVVGYALDYNEYFRDLNHICVINEHGKEKYRV

SEQ ID NO: 58015 - protein, 190 aa, Homo sapiens
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKSVLFAKDVVGTGRTMKALLSNIEKYKPNMIKVASLLVKRTSRSDGFRPDSHMRHQ

SEQ ID NO: 58016 - protein, 173 aa, Homo sapiens
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRLRARLKRTTICDRGGLAFSQGYMSSCAPLQESPNTLWRGYLQVLIPCFHIRFQLPRSEQN

SEQ ID NO: 58017 - protein, 190 aa, Homo sapiens
MAGSSEEAPDYGRGVVIMDDWPGYDLNLFTYPQHYYGDLEYVLIPHGIIVDRIERLAKDIMKDIGYSDIMVLCVLKGGYKFCADLVEHLKNISRNSDRFVSMKVDFIRLKSYRNDQSMGEMQIIGGDDLSTLAGKNVLIVEDVVGTGRTMKALLSNIEKYKPNMIKVASLLVKRTSRSDGFRPDSHMRHQ

SEQ ID NO: 58018 - protein, 432 aa, Homo sapiens
MATAEVLNIGKKLYEGKTKEVYELLDSPGKVLLQSKDQITAGNAARKNHLEGKAAISNKITSCIFQLLQEAVTSYKSNRIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 58019 - protein, 425 aa, Homo sapiens
MATAEVLNIGKKLYEGKTKEVYELLDSPGKVLLQSKDQITAGNAARKNHLEGKAAISNKITSCIFQLLQEAGIKTAFTRKCGETAFIAPQCEMIPIEWVCRRIATGSFLKRNPGVKEGYKFYPPKVELFFKDDANNDPQWSEEQLIAAKFCFAGLLIGQTEVDIMSHATQAIFEILEKSWLPQNCTLVDMKIEFGVDVTTKEIVLADVIDNDSWRLWPSGDRSQQKDKQSYRDLKEVTPEGLQMVKKNFEWVAERVELLLKSESQCRVVVLMGSTSDLGHCEKIKKACGNFGIPCELRVTSAHKGPDETLRIKAEYEGDGIPTVFVAVAGRSNGLGPVMSGNTAYPVISCPPLTPDWGVQDVWSSLRLPSGLGCSTVLSPEGSAQFAAQIFGLSNHLVWSKLRASILNTWISLKQADKKIRECNL

SEQ ID NO: 58020 - protein, 425 aa, Homo sapiens; identical to SEQ ID NO: 58019

SEQ ID NO: 58021 - protein, 1338 aa, Homo sapiens
MSPVLHFYVRPSGHEGAAPGHTRRKLQGKLPELQGVETELCYNVNWTAEALPSAEETKKLMWLFGCPLLLDDVARESWLLPGSNDLLLEVGPRLNFSTPTSTNIVSVCRATGLGPVDRVETTRRYRLSFAHPPSAEVEAIALATLHDRMTEQHFPHPIQSFSPESMPEPLNGPINILGEGRLALEKANQELGLALDSWDLDFYTKRFQELQRNPSTVEAFDLAQSNSEHSRHWFFKGQLHVDGQKLVHSLFESIMSTQESSNPNNVLKFCDNSSAIQGKEVRFLRPEDPTRPSRFQQQQGLRHVVFTAETHNFPTGVCPFSGATTGTGGRIRDVQCTGRGAHVVAGTAGYCFGNLHIPGYNLPWEDPSFQYPGNFARPLEVAIEASNGASDYGNKFGEPVLAGFARSLGLQLPDGQRREWIKPIMFSGGIGSMEADHISKEAPEPGMEVVKVGGPVYRIGVGGGAASSVQVQGDNTSDLDFGAVQRGDPEMEQKMNRVIRACVEAPKGNPICSLHDQGAGGNGNVLKELSDPAGAIIYTSRFQLGDPTLNALEIWGAEYQESNALLLRSPNRDFLTHVSARERCPACFVGTITGDRRIVLVDDRECPVRRNGQGDAPPTPLPTPVDLELEWVLGKMPRKEFFLQRKPPMLQPLALPPGLSVHQALERVLRLPAVASKRYLTNKVDRSVGGLVAQQQCVGPLQTPLADVAVVALSHEELIGAATALGEQPVKSLLDPKVAARLAVAEALTNLVFALVTDLRDVKCSGNWMWAAKLPGEGAALADACEAMVAVMAALGVAVDGGKDSLSMAARVGTETVRAPGSLVISAYAVCPDITATVTPDLKHPEGRGHLLYVALSPGQHRLGGTALAQCFSQLGEHPPDLDLPENLVRAFSITQGLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGAELRRFRKRPDTFSLGVCNGCQLLALLGWVGGDPNEDAAEMGPDSQPARPGLLLRHNLSGRYESRWASVRVGPGPALMLRGMEGAVLPVWSAHGEGYVAFSSPELQAQIEARGLAPLHWADDDGNPTEQYPLNPNGSPGGVAGICSCDGRHLAVMPHPERAVRPWQWAWRPPPFDTLTTSPWLQLFINARNWTLEGSC

SEQ ID NO: 58022 - protein, 914 aa, Homo sapiens
MFSGGIGSMEADHISKEAPEPGMEVVKVGGPVYRIGVGGGAASSVQVQGDNTSDLDFGAVQRGDPEMEQKMNRVIRACVEAPKGNPICSLHDQGAGGNGNVLKELSDPAGAIIYTSRFQLGDPTLNALEIWGAEYQESNALLLRSPNRDFLTHVSARERCPACFVGTITGDRRIVLVDDRECPVRRNGQGDAPPTPLPTPVDLELEWVLGKMPRKEFFLQRKPPMLQPLALPPGLSVHQALERVLRLPAVASKRYLTNKVDRSVGGLVAQQQCVGPLQTPLADVAVVALSHEELIGAATALGEQPVKSLLDPKVAARLAVAEALTNLVFALVTDLRDVKCSGNWMWAAKLPGEGAALADACEAMVAVMAALGVAVDGGKDSLSMAARVGTETVRAPGSLVISAYAVCPDITATVTPDLKHPEGRGHLLYVALSPGQHRLGGTALAQCFSQLGEHPPDLDLPENLVRAFSITQGLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGAELRRFRKRPDTFSLGVCNGCQLLALLGWVGGDPNEDAAEMGPDSQPARPGLLLRHNLSGRYESRWASVRVGPGPALMLRGMEGAVLPVWSAHGEGYVAFSSPELQAQIEARGLAPLHWADDDGNPTEQYPLNPNGSPGGVAGICSCDGRHLAVMPHPERAVRPWQWAWRPPPFDTLTTSPWLQLFINARNWTLEGSC

SEQ ID NO: 58023 - protein, 747 aa, Homo sapiens
VKGERRIVLVDDRECPVRRNGQGDAPPTPLPTPVDLELEWVLGKMPRKEFFLQRKPPMLQPLALPPGLSVHQALERVLRLPAVASKRYLTNKVDRSVGGLVAQQQCVGPLQTPLADVAVVALSHEELIGAATALGEQPVKSLLDPKVAARLAVAEALTNLVFALVTDLRDVKCSGNWMWAAKLPGEGAALADACEAMVAVMAALGVAVDGGKDSLSMAARVGTETVRAPGSLVISAYAVCPDITATVTPDLKHPEGRGHLLYVALSPGQHRLGGTALAQCFSQLGEHPPDLDLPENLVRAFSITQGLLKDRLLCSGHDVSDGGLVTCLLEMAFAGNCGLQVDVPVPRVDVLSVLFAEEPGLVLEVQEPDLAQVLKRYRDAGLHCLELGHTGEAGPHAMVRVSVNGAVVLEEPVGELRALWEETSFQLDRLQAEPRCVAEEERGLRERMGPSYCLPPTFPKASVPREPGGPSPRVAILREEGSNGDREMADAFHLAGFEVWDVTMQDLCSGAIGLDTFRGVAFVGGFSYADVLGSAKGWAAAVTFHPRAGAELRRFRKRPDTFSLGVCNGCQLLALLGWVGGDPNEDAAEMGPDSQPARPGLLLRHNLSGRYESRWASVRVGPGPALMLRGMEGAVLPVWSAHGEGYVAFSSPELQAQIEARGLAPLHWADDDGNPTEQYPLNPNGSPGGVAGICSCDGRHLAVMPHPERAVRPWQWAWRPPPFDTLTTSPWLQLFINARNWTLEGSC

SEQ ID NO: 58024 - protein, 433 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPR

SEQ ID NO: 58025 - protein, 1010 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQVSNDLLLKIKDTVLQRTVDGMQQEGTPYTGILYAGIMLTKNGPKVLEFNCRFGDPECQVILPLLKSDLYEVIQSTLDGLLCTSLPVWLENHTALTVVMASKGYPGDYTKGVEITGFPEAQALGLEVFHAGTALKNGKVVTHGGRVLAVTAIRENLISALEEAKKGLAAIKFEGAIYRKDVGFRAIAFLQQPRSLTYKESGVDIAAGNMLVKKIQPLAKATSRSGCKVDLGGFAGLFDLKAAGFKDPLLASGTDGVGTKLKIAQLCNKHDTIGQDLVAMCVNDILAQGAEPLFFLDYFSCGKLDLSVTEAVVAGIAKACGKAGCALLGGETAEMPDMYPPGEYDLAGFAVGAMERDQKLPHLERITEGDVVVGIASSGLHSNGFSLVRKIVAKSSLQYSSPAPDGCGDQTLGDLLLTPTRIYSHSLLPVLRSGHVKAFAHITGGGLLENIPRVLPEKLGVDLDAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 58026 - protein, 1010 aa, Homo sapiens; identical to SEQ ID NO: 58025

SEQ ID NO: 58027 - protein, 1010 aa, Homo sapiens; identical to SEQ ID NO: 58025

SEQ ID NO: 58028 - protein, 232 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGG

SEQ ID NO: 58029 - protein, 241 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFILSADFPALVVKASGLAAGKGVIVAKSKEEACKAVQEIMQEKAFGAAGETIVIEELLDGEEVSCLCFTDGKTVAPMPPAQDHKRLLEGDGGPNTGGMGAYCPAPQ

SEQ ID NO: 58030 - protein, 138 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSFIL

SEQ ID NO: 58031 - protein, 136 aa, Homo sapiens
MAARVLIIGSGGREHTLAWKLAQSHHVKQVLVAPGNAGTACSEKISNTAISISDHTALAQFCKEKKIEFVVVGPEAPLAAGIVGNLRSAGVQCFGPTAEAAQLESSKRFAKEFMDRHGIPTAQWKAFTKPEEACSF

SEQ ID NO: 58032 - protein, 562 aa, Homo sapiens
MLVKKIQPLAKATSRSGCKVDLGGFAGLFDLKAAGFKDPLLASGTDGVGTKLKIAQLCNKHDTIGQDLVAMCVNDILAQGAEPLFFLDYFSCGKLDLSVTEAVVAGIAKACGKAGCALLGGETAEMPDMYPPGEYDLAGFAVGAMERDQKLPHLERITEGDVVVGIASSGLHSNGFSLVRKIVAKSSLQYSSPAPDGCGDQTLGDLLLTPTRIYSHSLLPVLRSGHVKAFAHITGGGLLENIPRVLPEKLGVDLDAQTWRIPRVFSWLQQEGHLSEEEMARTFNCGVGAVLVVSKEQTEQILRDIQQHKEEAWVIGSVVARAEGSPRVKVKNLIESMQINGSVLKNGSLTNHFSFEKKKARVAVLISGTGSNLQALIDSTREPNSSAQIDIVISNKAAVAGLDKAERAGIPTRVINHKLYKNRVEFDSAIDLVLEEFSIDIVCLAGFMRILSGPFVQKWNGKMLNIHPSLLPSFKGSNAHEQALETGVTVTGCTVHFVAEDVDAGQIILQEAVPVKRGDTVATLSERVKLAEHKIFPAALQLVASGTVQLGENGKICWVKEE

SEQ ID NO: 58033 - protein, 754 aa, Homo sapiens
MSRPLSDQEKRKQISVRGLAGVENVTELKKNFNRHLHFTLVKDRNVATPRDYYFALAHTVRDHLVGRWIRTQQHYYEKDPKKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIGDVVNHDPAVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 58034 - protein, 1210 aa, Homo sapiens
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 58035 - protein, 1240 aa, Homo sapiens
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSNGGHPLGIDLMSPSFMSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 58036 - protein, 1223 aa, Homo sapiens
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHARCGDEVARYLDHLLAHTAPHPKLAPTSQKGGLDRFQAAVQTTCDLMSLVTKAKELHVQNVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 58037 - protein, 1181 aa, Homo sapiens
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHDVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQVEFRRLSISAESQSNGGHPLGIDLMSPSFMSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 58038 - protein, 1151 aa, Homo sapiens
MRSRSNSGVRLDGYARLVQQTILCHQNPVTGLLPASYDQKDAWVRDNVYSILAVWGLGLAYRKNADRDEDKAKAYELEQSVVKLMRGLLHCMIRQVDKVESFKYSQSTKDSLHAKYNTKTCATVVGDDQWGHLQLDATSVYLLFLAQMTASGLHIIHSLDEVNFIQNLVFYIEAAYKTADFGIWERGDKTNQGISELNASSVGMAKAALEALDELDLFGVKGGPQSVIHVLADEVQHCQSILNSLLPRASTSKEVDASLLSVVSFPAFAVEDSQLVELTKQEIITKLQGRYGCCRFLRDGYKTPKEDPNRLYYEPAELKLFENIECEWPLFWTYFILDGVFSGNAEQVQEYKEALEAVLIKGKNGVPLLPELYSVPPDRVDEEYQNPHTVDRVPMGKLPHMWGQSLYILGSLMAEGFLAPGEIDPLNRRFSTVPKPDVVVQVSILAETEEIKTILKDKGIYVETIAEVYPIRVQPARILSHIYSSLGCNNRMKLSGRPYRHMGVLGTSKLYDIRKTIFTFTPQFIDQQQFYLALDNKMIVEMLRTDLSYLCSRWRMTGQPTITFPISHSMLDEDGTSLNSSILAALRKMQDGYFGGARVQTGKLSEFLTTSCCTHLSFMDPGPEGKLYSEDYDDNYDYLESGNWMNDYDSTSHDVHMYLPTKLFQASRPSFNLLDSPHPRQENQVPSVRVEIHLPRDQSGEVDFKALVLQLKETSSLQEQADILYMLYTMKGPDWNTELYNERSATVRELLTELYGKVGEIRHWGLIRYISGILRKKVEALDEACTDLLSHQKHLTVGLPPEPREKTISAPLPYEALTQLIDEASEGDMSISILTQEIMVYLAMYMRTQPGLFAEMFRLRIGLIIQVMATELAHSLRCSAEEATEGLMNLSPSAMKNLLHHILSGKEFGVERSVRPTDSNVSPAISIHEIGAVGATKTERTGIMQLKSEIKQSPGTSMTPSSGSFPSAYDQQSSKDSRQGQWQRRRRLDGALNRVPVGFYQKVWKVLQKCHGLSVEGFVLPSSTTREMTPGEIKFSVHVESVLNRVPQPEYRQLLVEAILVLTMLADIEIHSIGSIIAVEKIVHIANDLFLQEQKTLGADDTMLAKDPASGICTLLYDSAPSGRFGTMTYLSKAAATYVQEFLPHSICAMQ

SEQ ID NO: 58039 - protein, 387 aa, Homo sapiens
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 58040 - protein, 419 aa, Homo sapiens
MTRDEALPDSHSAQDFYENYEPKEILGRGVSSVVRRCIHKPTSQEYAVKVIDVTGGGSFSPEEVRELREATLKEVDILRKVSGHPNIIQLKDTYETNTFFFLVFDLWEDTDTMEMEQKWCLGWDSPKSTNFRAQGRARMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 58041 - protein, 333 aa, Homo sapiens
MHPQAHEPGVRREGHRRHRWRQLQPGGGAGAARSHAEGGGHPAQGLRAPQHQMKRGELFDYLTEKVTLSEKETRKIMRALLEVICTLHKLNIVHRDLKPENILLDDNMNIKLTDFGFSCQLEPGERLREVCGTPSYLAPEIIECSMNEDHPGYGKEVDMWSTGVIMYTLLAGSPPFWHRKQMLMLRMIMSGNYQFGSPEWDDYSDTVKDLVSRFLVVQPQNRYTAEEALAHPFFQQYLVEEVRHFSPRGKFKVIALTVLASVRIYYQYRRVKPVTREIVIRDPYALRPLRRLIDAYAFRIYGHWVKKGQQQNRAALFENTPKAVLLSLAEEDY

SEQ ID NO: 58042 - protein, 842 aa, Homo sapiens
MSRPLSDQEKRKQISVRGLAGVENVTELKKNFNRHLHFTLVKDRNVATPRDYYFALAHTVRDHLVGRWIRTQQHYYEKDPKRIYYLSLEFYMGRTLQNTMVNLALENACDEATYQLGLDMEELEEIEEDAGLGNGGLGRLAACFLDSMATLGLAAYGYGIRYEFGIFNQKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIGDVVNHDPAVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPDEAI

SEQ ID NO: 58043 - protein, 832 aa, Homo sapiens
MSRPLSDQEKRKQISVRGLAGVENVTELKKNFNRHLHFTLVKDRNVATPRDYYFALAHTVRDHLVGRWIRTQQHYYEKDPKRIYYLSLEFYMGRTLQNTMVNLALENACDEATYQVGLGRLAACFLDSMATLGLAAYGYGIRYEFGIFNQKISGGWQMEEADDWLRYGNPWEKARPEFTLPVHFYGHVEHTSQGAKWVDTQVVLAMPYDTPVPGYRNNVVNTMRLWSAKAPNDFNLKDFNVGGYIQAVLDRNLAENISRVLYPNDNFFEGKELRLKQEYFVVAATLQDIIRRFKSSKFGCRDPVRTNFDAFPDKVAIQLNDTHPSLAIPELMRILVDLERMDWDKAWDVTVRTCAYTNHTVLPEALERWPVHLLETLLPRHLQIIYEINQRFLNRVAAAFPGDVDRLRRMSLVEEGAVKRINMAHLCIAGSHAVNGVARIHSEILKKTIFKDFYELEPHKFQNKTNGITPRRWLVLCNPGLAEVIAERIGEDFISDLDQLRKLLSFVDDEAFIRDVAKVKQENKLKFAAYLEREYKVHINPNSLFDIQVKRIHEYKRQLLNCLHVITLYNRIKREPNKFFVPRTVMIGGKAAPGYHMAKMIIRLVTAIGDVVNHDPAVGDRLRVIFLENYRVSLAEKVIPAADLSEQISTAGTEASGTGNMKFMLNGALTIGTMDGANVEMAEEAGEENFFIFGMRVEDVDKLDQRGYNAQEYYDRIPELRQVIEQLSSGFFSPKQPDLFKDIVNMLMHHDRFKVFADYEDYIKCQEKVSALYKNPREWTRMVIRNIATSGKFSSDRTIAQYAREIWGVEPSRQRLPAPAPHAEGGVLELDL

SEQ ID NO: 58044 - protein, 843 aa, Homo sapiens
MAKPLTDSEKRKQISVRGLAGLGDVAEVRKSFNRHLHFTLVKDRNVATPRDYFFALAHTVRDHLVGRWIRTQQHYYERDPKRIYYLSLEFYMGRTLQNTMVNLGLQNACDEAIYQLGLDLEELEEIEEDAGLGNGGLGRLAACFLDSMATLGLAAYGYGIRYEFGIFNQKIVNGWQVEEADDWLRYGNPWEKARPEYMLPVHFYGRVEHTPDGVKWLDTQVVLAMPYDTPVPGYKNNTVNTMRLWSAKAPNDFKLQDFNVGDYIEAVLDRNLAENISRVLYPNDNFFEGKELRLKQEYFVVAATLQDIIRRFKSSKFGCRDPVRTCFETFPDKVAIQLNDTHPALSIPELMRILVDVEKVDWDKAWEITKKTCAYTNHTVLPEALERWPVSMFEKLLPRHLEIIYAINQRHLDHVAALFPGDVDRLRRMSVIEEGDCKRINMAHLCVIGSHAVNGVARIHSEIVKQSVFKDFYELEPEKFQNKTNGITPRRWLLLCNPGLADTIVEKIGEEFLTDLSQLKKLLPLVSDEVFIRDVAKVKQENKLKFSAFLEKEYKVKINPSSMFDVHVKRIHEYKRQLLNCLHVVTLYNRIKRDPAKAFVPRTVMIGGKAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIWGVEPSDLQIPPPNIPRD

SEQ ID NO: 58045 - protein, 245 aa, Homo sapiens
  MOD_RES (1)..(1): Any amino acid
XKHHHTVPPSVTPKALDRSPPCPEMFTRAAPGYHMAKLIIKLVTSIGDVVNHDPVVGDRLKVIFLENYRVSLAEKVIPAADLSQQISTAGTEASGTGNMKFMLNGALTIGTMDGANVEMAEEAGAENLFIFGLRVEDVEALDRKGYNAREYYDHLPELKQAVDQISSGFFSPKEPDCFKDIVNMLMHHDRFKVFADYEAYMQCQAQVDQLYRNPKEWTKKVIRNIACSGKFSSDRTITEYAREIW

SEQ ID NO: 58046 - protein, 324 aa, Homo sapiens
MDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVSVGGIRASLYNAVTIEDVQKLAAFMKKFLEMHQL

SEQ ID NO: 58047 - protein, 370 aa, Homo sapiens
MDAPRQVVNFGPGPAKLPHSVLLEIQKELLDYKGVGISVLEMSHRSSDFAKIINNTENLVRELLAVPDNYKVIFLQGGGCGQFSAVPLNLIGLKAGRCADYVVTGAWSAKAAEEAKKFGTINIVHPKLGSYTKIPDPSTWNLNPDASYVYYCANETVHGVEFDFIPDVKGAVLVCDMSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 58048 - protein, 194 aa, Homo sapiens
MSSNFLSKPVDVSKFGVIFAGAQKNVGSAGVTVVIVRDDLLGFALRECPSVLEYKVQAGNSSLYNTPPCFSIYVMGLVLEWIKNNGGAAAMEKLSSIKSQTIYEIIDNSQGFYVCPVEPQNRSKMNIPFRIGNAKGDDALEKRFLDKALELNMLSLKGHRSVGGIRASLYNAVTIEDVQKLAAFMKKFLEMHQL

SEQ ID NO: 58049 - protein, 349 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRTILDKKELLEFAQLGCYLEYDLFGTELLHYQLGPDIDMPDDNKRIRRVRLLVEEGCEDRILVAHDIHTKTRLMKYGGHGYSHILTNVVPKMLLRGITENVLDKILIENPKQWLTFK

SEQ ID NO: 58050 - protein, 349 aa, Homo sapiens; identical to SEQ ID NO: 58049

SEQ ID NO: 58051 - protein, 349 aa, Homo sapiens; identical to SEQ ID NO: 58049

SEQ ID NO: 58052 - protein, 302 aa, Homo sapiens
MSSLSGKVQTVLGLVEPSKLGRTLTHEHLAMTFDCCYCPPPPCQEAISKEPIVMKNLYWIQKNAYSHKENLQLNQETEAIKEELLYFKANGGGALVENTTTGISRDTQTLKRLAEETGVHIISGAGFYVDATHSSETRAMSVEQLTDVLMNEILHGADGTSIKCGIIGEIGCSWPLTESERKVLQATAHAQAQLGCPVIIHPGRSSRAPFQIIRILQEAGADISKTVMSHLDRVRLLVEEGCEDRILVAHDIHTKTRLMKYGGHGYSHILTNVVPKMLLRGITENVLDKILIENPKQWLTFK

SEQ ID NO: 58053 - protein, 349 aa, Homo sapiens; identical to SEQ ID NO: 58049

SEQ ID NO: 58054 - protein, 250 aa, Homo sapiens
MFSLPLSLPLCEDTAFLPSKCCSSHKTIKQARTLIMIFLASGTHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 58055 - protein, 248 aa, Homo sapiens
MPRIAGNHLMLEESRTCSSPELLDGVWPCQPLHFGLPASEMHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 58056 - protein, 217 aa, Homo sapiens
MWQPATERLQHFQTMLKSKLNVLTLKKEPLPAVIFHEPEAIELCTTTPLMKTRTHSGCKVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 58057 - protein, 168 aa, Homo sapiens
MWQPATERLQVTYLGKVSTTGMQFLSGCTEKPVIELWKKHTLAREDVFPANALLEIRPFQVWLHHLDHKGEATVHMDTFQVARIAYCTADHNVSPNIFAWVYREINDDLSYQMDCHAVECESKLEAKKLAHAMMEAFRKTFHSMKSDGRIHSNSSSEEVSQELESDDG

SEQ ID NO: 58058 - protein, 250 aa, Homo sapiens; identical to SEQ ID NO: 58054

SEQ ID NO: 58059 - protein, 338 aa, Homo sapiens
MEQLRAAARLQIVLGHLGRPSAGAVVAHPTSGTISSASFHPQQFQYTLDNNVLTLEQRKFYEENGFLVIKNLVPDADIQRFRNEFEKICRKEVKPLGLTVMRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 58060 - protein, 238 aa, Homo sapiens
MRDVTISKSEYAPSEKMITKVQDFQEDKELFRYCTLPEILKYVECFTGPNIMAMHTMLINKPPDSGKKTSRHPLHQDLHYFPFRPSDLIVCAWTAMEHISRNNGCLVVLPGTHKGSLKPHDYPKWEGGVNKMFHGIQDYEENKARVHLVMEKGDTVFFHPLLIHGSGQNKTQGFRKAISCHFASADCHYIDVKGTSQENIEKEVVGIAHKFFGAENSVNLKDIWMFRARLVKGERTNL

SEQ ID NO: 58061 - protein, 5142 aa, Homo sapiens
MGNEASLEGEGLPEGLAAAAAAGGGASGAGSPSHTAIPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPVQQPGPGKIPAQQAGPGKTSAQQTGPTKPPSQLPGPAKPPPQQPGPAKPPPQQPGSAKPPSQQPGSTKPPPQQPGPAKPSPQQPGSTKPPSQQPGSAKPSAQQPSPAKPSAQQSTKPVSQTGSGKPLQPPTVSPSAKQPPSQGLPKTICPLCNTTELLLHVPEKANFNTCTECQTTVCSLCGFNPNPHLTEVKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVSPFDSKAIPRPASDSKIISHPGPSSESKGQKQVDPVQKKEEPKKAQTKMSPKPDAKPMPKGSPTPPGPRPTAGQTVPTPQQSPKPQEQSRRFSLNLGSITDAPKSQPTTPQETVTGKLFGFGASIFSQASNLISTAGQPGPHSQSGPGAPMKQAPAPSQPPTSQGPPKSTGQAPPAPAKSIPVKKETKAPAAEKLEPKAEQAPTVKRTETEKKPPPIKDSKSLTAEPQKAVLPTKLEKSPKPESTCPLCKTELNIGSKDPPNFNTCTECKNQVCNLCGFNPTPHLTEIQEWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQVEPGKEKTEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASASYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGEVMDYSSKTTGPYPETRQVISGAGISTPQYSTARMTPPPGPQYCVGSVLRSSNGVVYSSVATPTPSTFAITTQPGSIFSTTVRDLSGIHTADAVTSLPAMHHSQPMPRSYFITTGASETDIAVTGIDISASLQTITMESLTAETIDSVPTLTTASEVFPEVVGDESALLIVPEEDKQQQQLDLERELLELEKIKQQRFAEELEWERQEIQRFREQEKIMVQKKLEELQSMKQHLLFQQEEERQAQFMMRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYTTKGSQTMTSSGAQKKVKRTLPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSGNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGQVMVVQNASAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPTKPPNHRPAESSVSTGSSGSSFGSGYSVDSEGSSSTAGETNLFPIPRIGKMGQNGQEPVKQPGVGVGLADTEAKTQVMGEIKIALKKEMKTDGEQLIVEILQCRNITYKFKSPDHLPDLYVKIYVMNISTQKKVIKKKTRVCRHDREPSFNETFRFSLSPAGHSLQILLFSNGGKFMKKTLIGEACIWLDKVDLRKRIVNWHKLLVSPTQTH

SEQ ID NO: 58062 - protein, 422 aa, Homo sapiens
TKVWNSNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPSKRRK

SEQ ID NO: 58063 - protein, 4935 aa, Homo sapiens
MGNEASLEGEGLPEGLAAAAAAGGGASGAGSPSHTAIPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPVQQPGPGKIPAQQAGPGKTSAQQTGPTKPPSQLPGPAKPPPQQPGPAKPPPQQPGSAKPPSQQPGSTKPPPQQPGPAKPSPQQPGSTKPPSQQPGSAKPSAQQPSPAKPSAQQSTKPVSQTGSGKPLQPPTVSPSAKQPPSQGLPKTICPLCNTTELLLHVPEKANFNTCTECQTTVCSLCGFNPNPHLTEVKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVSPFDSKAIPRPASDSKIISHPGPSSESKGQKQVDPVQKKEEPKKAQTKMSPKPDAKPMPKGSPTPPGPRPTAGQTVPTPQQSPKPQEQSRRFSLNLGSITDAPKSQPTTPQETVTGKLFGFGASIFSQASNLISTAGQPGPHSQSGPGAPMKQAPAPSQPPTSQGPPKSTGQAPPAPAKSIPVKKETKAPAAEKLEPKAEQAPTVKRTETEKKPPPIKDSKSLTAEPQKAVLPTKLEKSPKPESTCPLCKTELNIGSKDPPNFNTCTECKNQVCNLCGFNPTPHLTEIQEWLCLNCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQVEPGKEKTEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASASYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGEVMDYSSKTTGPYPETRQVISGAGISTPQYSTARMTPPPGPQYCVGSVLRSSNGVVYSSVATPTPSTFAITTQPGSIFSTTVRDLSGIHTADAVTSLPAMHHSQPMPRSYFITTGASETDIAVTGIDISASLQTITMESLTAETIDSVPTLTTASEVFPEVVGDESALLIVPEEDKQQQQLDLERELLELEKIKQQRFAEELEWERQEIQRFREQEKIMVQKKLEELQSMKQHLLFQQEEERQAQFMMRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYTTKGSQTMTSSGAQKKVKRTLPNPPPEEISTGTQSTFSTMGTVSRRRICRTNTMARAKILQDIDRELDLVERESAKLRKKQAELDEEEKEIDAKLRYLEMGINRRKEALLKEREKRERAYLQGVAEDRDYMSDSEVSSTRPTRIESQHGIERPRTAPQTEFSQFIPPQTQTESQLVPPTSPYTQYQYSSPALPTQAPTSYTQQSHFEQQTLYHQQVSPYQTQPTFQAVATMSFTPQVQPTPTPQPSYQLPSQMMVIQQKPRQTTLYLEPKITSNYEVIRNQPLMIAPVSTDNTFAVSHLGSKYNSLDLRIGLEERSSMASSPISSISADSFYADIDHHTPRNYVLIDDIGEITKGTAALSTAFSLHEKDLSKTDRLLRTTETRRSQEVTDFLAPLQSSSRLHSYVKAEEDPMEDPYELKLLKHQIKQEFRRGTESLDHLAGLSHYYHADTSYRHFPKSEKYSISRLTLEKQAAKQLPAAILYQKQSKHKKSLIDPKMSKFSPIQESRDLEPDYSSYMTSSTSSIGGISSRARLLQDDITFGLRKNITDQQKFMGSSLGTGLGTLGNTIRSALQDEADKPYSSGSRSRPSSRPSSVYGLDLSIKRDSSSSSLRLKAQEAEALDVSFSHASSSARTKPTSLPISQSRGRIPIVAQNSEEESPLSPVGQPMGMARAAAGPLPPISADTRDQFGSSHSLPEVQQHMREESRTRGYDRDIAFIMDDFQHAMSDSEAYHLRREETDWFDKPRESRLENGHGLDRKLPERLVHSRPLSQHQEQIIQMNGKTMHYIFPHARIKITRDSKDHTVSGNGLGIRIVGGKEIPGHSGEIGAYIAKILPGGSAEQTGKLMEGMQVLEWNGIPLTSKTYEEVQSIISQQSGEAEICVRLDLNMLSDSENSQHLELHEPPKAVDKAKSPGVDPKQLAAELQKVSLQQSPLVLSSVVEKGSHVHSGPTSAGSSSVPSPGQPGSPSVSKKKHGSSKPTDGTKVVSHPITGEIQLQINYDLGNLIIHILQARNLVPRDNNGYSDPFVKVYLLPGRGQVMVVQNASAEYKRRTKHVQKSLNPEWNQTVIYKSISMEQLKKKTLEVTVWDYDRFSSNDFLGEVLIDLSSTSHLDNTPRWYPLKEQTESIDHGKSHSSQSSQQSPKPSVIKSRSHGIFPDPSKDMQVPTIEKSHSSPGSSKSSSEGHLRSHGPSRSQSKTSVTQTHLEDAGAAIAAAEAAVQQLRIQPSKRRK

SEQ ID NO: 58064 - protein, 3635 aa, Homo sapiens
MGNEASLEGEGLPEGLAAAAAAGGGASGAGSPSHTAIPAGMEADLSQLSEEERRQIAAVMSRAQGLPKGSVPPAAAESPSMHRKQELDSSHPPKQSGRPPDPGRPAQPGLSKSRTTDTFRSEQKLPGRSPSTISLKESKSRTDLKEEHKSSMMPGFLSEVNALSAVSSVVNKFNPFDLISDSEASQEETTKKQKVVQKEQGKPEGIIKPPLQQQPPKPIPKQQGPGRDPLQQDGTPKSISSQQPEKIKSQPPGTGKPIQGPTQTPQTDHAKLPLQRDASRPQTKQADIVRGESVKPSLPSPSKPPIQQPTPGKPPAQQPGHEKSQPGPAKPPAQPSGLTKPLAQQPGTVKPPVQPPGTTKPPAQPLGPAKPPAQQTGSEKPSSEQPGPKALAQPPGVGKTPAQQPGPAKPPTQQVGTPKPLAQQPGLQSPAKAPGPTKTPVQPKPPSQQPGSTKPPPQQPGPAKPSPQQPGSTKPPSQQPGSAKPSAQQPSPAKPSAQQSTKPVSQTGSGKPLQPPTVSPSAKQPPSQGLPKTICPLCNTTELLLHVPEKANFNTCTECQTTVCSLCGFNPNPHLTEVKEWLCLNCQMKRALGGDLAPVPSSPQPKLKTAPVTTTSAVSKSSPQPQQTSPKKDAAPKQDLSKAPEPKKPPPLVKQPTLHGSPSAKAKQPPEADSLSKPAPPKEPSVPSEQDKAPVADDKPKQPKMVKPTTDLVSSSSATTKPDIPSSKVQSQAEEKTTPPLKTDSAKPSQSFPPTGEKVSPFDSKAIPRPASDSKIISHPGPSSESKGQKQVDPVQKKEEPKKAQTKMSPKPDAKPMPKGSPTPPGPRPTAGQTVPTPQQSPKPQEQSRRFSLNLGSITDAPKSQPTTPQETVTGKLFGFGASIFSQASNLISTAGQPGPHSQSGPGAPMKQAPAPSQPPTSQGPPKSTGQAPPAPAKSIPVKKETKAPAAEKLEPKAEQAPTVKRTETEKKPPPIKDSKSLTAEPQKAVLPTKLEKSPKPESTCPLCKTELNIGSKDPPNFNTCTECKNQVCNLCGFNPTPHLTENCQTQRAISGQLGDIRKMPPAPSGPKASPMPVPTESSSQKTAVPPQVKLVKKQEQEVKTEAEKVILEKVKETLSMEKIPPMVTTDQKQEESKLEKDKASALQEKKPLPEEKKLIPEEEKIRSEEKKPLLEEKKPTPEDKKLLPEAKTSAPEEQKHDLLKSQVQIAEEKLEGRVAPKTVQEGKQPQTKMEGLPSGTPQSLPKEDDKTTKTIKEQPQPPCTAKPDQEKEDDKSDTSSSQQPKSPQGLSDTGYSSDGISSSLGEIPSLIPTDEKDILKGLKKDSFSQESSPSSPSDLAKLESTVLSILEAQASTLADEKSEKKTQPHEVSPEQPKDQEKTQSLSETLEITISEEEIKESQEERKDTFKKDSQQDIPSSKDHKEKSEFVDDITTRREPYDSVEESSESENSPVPQRKRRTSVGSSSSDEYKQEDSQGSGEEEDFIRKQIIEMSADEDASGSEDDEFIRNQLKEISSSTESQKKEETKGKGKITAGKHRRLTRKSSTSIDEDAGRRHSWHDEDDEAFDESPELKYRETKSQESEELVVTGGGGLRRFKTIELNSTIADKYSAESSQKKTSLYFDEEPELEMESLTDSPEDRSRGEGSSSLHASSFTPGTSPTSVSSLDEDSDSSPSHKKGESKQQRKARHRPHGPLLPTIEDSSEEEELREEEELLKEQEKQREIEQQQRKSSSKKSKKDKDELRAQRRRERPKTPPSNLSPIEDASPTEELRQAAEMEELHRSSCSEYSPSIESDPEGFEISPEKIIEVQKVYKLPTAVSLYSPTDEQSIMQKEGSQKALKSAEEMYEEMMHKTHKYKAFPAANERDEVFEKEPLYGGMLIEDYIYESLVEDTYNGSVDGSLLTRQEEENGFMQQKGREQKIRLSEQIYEDPMQKITDLQKEFYELESLHSVVPQEDIVSSSFIIPESHEIVDLGTMVTSTEEERKLLDADAAYEELMKRQQMQLTPGSSPTQAPIGEDMTESTMDFDRMPDASLTSSVLSGASLTDSTSSATLSIPDVKITQHFSTEEIEDEYVTDYTREIQEIIAHESLILTYSEPSESATSVPPSDTPSLTSSVSSVCTTDSSSPITTLDSITTVYTEPVDMITKFEDSEEISSSTYFPGSIIDYPEEISVSLDRTAPPDGRASADHIVISLSDMASSIIESVVPKPEGPVADTVSTDLLISEKDPVKKAKKETGNGIILEVLEAYRDKKELEAERTKSSLSETVFDHPPSSVIALPMKEQLSTTYFTSGETFGQEKPASQLPSGSPSVSSLPAKPRPFFRSSSLDISAQPPPPPPPPPPPPPPPPPPPPPPLPPPTSPKPTILPKKKLTVASPVTTATPLFDAVTTLETTAVLRSNGLPVTRICTTAPPPVPPKPSSIPSGLVFTHRPEPSKPPIAPKPVIPQLPTTTQKPTDIHPKPTGLSLTSSMTLNLVTSADYKLPSPTSPLSPHSNKSSPRFSKSLTETYVVITLPSEPGTPTDSSASQAITSWPLGSPSKDLVSVEPVFSVVPPVTAVEIPISSEQTFYISGALQTFSATPVTAPSSFQAAPTSVTQFLTTEVSKTEVSATRSTAPSVGLSSISITIPPEPLALDNIHLEKPQYKEDGKLQLVGDVIDLRTVPKVEVKTTDKCIDLSASTMDVKRQITANEVYGKQISAVQPSIINLSVTSSIVTPVSLATETVTFVTCTASASYTTGTESLVGAEHAMTTPLQLTTSKHAEPPYRIPSDQVFPIAREEAPINLSLGTPAHAVTLAITKPVTVPPVGVTNGWTDSTVSQGITDGEVVDLSTTKSHRTVVTMDESTSSVMTKIIEDEKPVDLTAGRRAVCCDVVYKLPFGRSCTAQQPATTLPEDRFGYRDDHYQYDRSGPYGYRGIGGMKPSMSDTNLAEAGHFFYKSKNAFDYSEGTDTAVDLTSGRVTTGEVMDYSSKTTGPYPETRQVISGAGISTPQYSTARMTPPPGPQYCVGSVLRSSNGVVYSSVATPTPSTFAITTQPGSIFSTTVRDLSGIHTADAVTSLPAMHHSQPMPRSYFITTGASETDIAVTGIDISASLQTITMESLTAETIDSVPTLTTASEVFPEVVGDESALLIVPEEDKQQQQLDLERELLELEKIKQQRFAEELEWERQEIQRFREQEKIMVQKKLEELQSMKQHLLFQQEEERQAQFMMRQETLAQQQLQLEQIQQLQQQLHQQLEEQKIRQIYQYNYDPSGTASPQTTTEQAILEGQYAALEGSQFWATEDATTTASAVVAIEIPQSQGWYTVQSDGVTQYIAPPGILSTVSEIPLTDVVVKEEKQPKKRSSGAKVRGQYDDMGENMTDDPRSFKKIVDSGVQTDDEDATDRSYVSRRRRTKKSVDTSVQTDDEDQDEWDMPTRSRRKARVGKYGDSMTEADKTKPLSKVSSIAVQTVAEISVQTEPVGTIRTPSIRARVDAKVEIIKHISAPEKTYKGGSLGCQTEADSDTQSPQYLSATSPPKDKKRPTPLEIGYSSHLRADSTVQLAPSPPKSPKVLYSPISPLSPGKALESAFVPYEKPLPDDISPQKVLHPDMAKVPPASPKTAKMMQRSMSDPKPLSPTADESSRAPFQYTEGYT

SEQ ID NO: 58065 - protein, 544 aa, Homo sapiens
MEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 58066 - protein, 2752 aa, Homo sapiens
MASEVVCGLIFRLLLPICLAVACAFRYNGLSFVYLIYLLLIPLFSEPTKTTMQGHTGRLLKSLCFISLSFLLLHIIFHITLVSLEAQHRIAPGYNCSTWEKTFRQIGFESLKGADAGNGIRVFVPDIGMFIASLTIWLLCRNIVQKPVTDEAAQSNPEFENEELAEGEKIDSEEALIYEEDFNGGDGVEGELEESTKLKMFRRLASVASKLKEFIGNMITTAGKVVVTILLGSSGMMLPSLTSSVYFFVFLGLCTWWSWCRTFDPLLFSCLCVLLAIFTAGHLIGLYLYQFQFFQEAVPPNDYYARLFGIKSVIQTDCSSTWKIIVNPDLSWYHHANPILLLVMYYTLATLIRIWLQEPLVQDEGTKEEDKALACSPIQITAGRRRSLWYATHYPTDERKLLSMTQDDYKPSDGLLVTVNGNPVDYHTIHPSLPMENGPGKADLYSTPQYRWEPSDESSEKREEEEEEKEEFEEERSREEKRSIKVHAMVSVFQFIMKQSYICALIAMMAWSITYHSWLTFVLLIWSCTLWMIRNRRKYAMISSPFMVVYGNLLLILQYIWSFELPEIKKVPGFLEKKEPGELASKILFTITFWLLLRQHLTEQKALQEKEALLSEVKIGSQENEEKDEELQDIQVEGEPKEEEEEEAKEEKQERKKVEQEEAEEEDEQDIMKVLGNLVVAMFIKYWIYVCGGMFFFVSFEGKIVMYKIIYMVLFLFCVALYQVHYEWWRKILKYFWMSVVIYTMLVLIFIYTYQFENFPGLWQNMTGLKKEKLEDLGLKQFTVAELFTRIFIPTSFLLVCILHLHYFHDRFLELTDLKSIPSKEDNTIYRLAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNPVPDFIHCRSYLDMSKVIIFSYLFWFVLTIIFITGTTRISIFCMGYLVACFYFLLFGGDLLLKPIKSILRYWDWLIAYNVFVITMKNILSIGACGYIGTLVHNSCWLIQAFSLACTVKGYQMPAANSPCTLPSGEAGIIWDSICFAFLLLQRRVFMSYYFLHVVADIKASQILASRGAELFQATIVKAVKARIEEEKKSMDQLKRQMDRIKARQQKYKKGKERMLSLTQEPGEGQDMQKLSEEDDEREADKQKAKGKKKQWWRPWVDHASMVRSGDYYLFETDSEEEEEEELKKEDEEPPRRSAFQFVYQAWITDPKTALRQRHKEKKRSAREERKRRRKGSKEGPVEWEDREDEPIKKKSDGPDNIIKRIFNILKFTWVLFLATVDSFTTWLNSISREHIDISTVLRIERCMLTREIKKGNVPTRESIHMYYQNHIMNLSRESGLDTIDEHPGAASGAQTAHRMDSLDSHDSISSEPTQCTMLYSRQGTTETIEEVEAEQEEEAGSTAPEPREAKEYEATGYDVGAMGAEEASLTPEEELTQFSTLDGDVEAPPSYSKAVSFEHLSFGSQDDSAGKNRMAVSPDDSRTDKLGSSILPPLTHELTASELLLKKMFHDDELEESEKFYVGQPRFLLLFYAMYNTLVARSEMVCYFVIILNHMVSASMITLLLPILIFLWAMLSVPRPSRRFWMMAIVYTEVAIVVKYFFQFGFFPWNKNVEVNKDKPYHPPNIIGVEKKEGYVLYDLIQLLALFFHRSILKCHGLWDEDDMTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 58067 - protein, 563 aa, Homo sapiens
MSVVIYTMLVLIFIYTYQFENFPGLWQNMTGLKKEKLEDLGLKQFTVAELFTRIFIPTSFLLVCILHLHYFHDRFLELTDLKSIPSKEDNTIYSHAKVNGRVYLIINSIKKKLPIHQNELAHPEGSLPDLTMMHLTASLEKPEVRKLAEPGEEKLEGYSEKAQKGDLGKDSEESEEDGEEEEESEEEEETSDLRNKWHLVIDRLTVLFLKFLEYFHKLQVFMWWILELHIIKIVSSYIIWVSVKEVSLFNYVFLISWAFALPYAKLRRLASSVCTVWTCVIIVCKMLYQLQTIKPENFSVNCSLPNENQTNIPFNELNKSLLYSAPIDPTEWVGLRKSSPLLVYLRNNLLMLAILAFEVTIYRHQEYYRGRNNLTAPVSRTIFHDITRLHLDDGLINCAKYFINYFFYKFGLETCFLMSVNVIGQRMDFYAMIHACWLIAVLYRRRRKAIAEIWPKYCCFLACIITFQYFICIGIPPAPCRDYPWRFKGASFNDNIIKWLYFPDFIVRPNPVFLVYDFMLLLCASLQRQIFEDENKAAVRIMAGDNVEICMNLDAASFSQHNP

SEQ ID NO: 58068 - protein, 646 aa, Homo sapiens
MTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 58069 - protein, 709 aa, Homo sapiens
MTESGMAREESDDELSLGHGRRDSSDSLKSINLAASVESVHVTFPEQQTAVRRKRSGSSSEPSQRSSFSSNRSQRGSTSTRNSSQKGSSVLSIKQKGKRELYMEKLQEHLIKAKAFTIKKTLEIYVPIKQFFYNLIHPEYSAVTDVYVLMFLADTVDFIIIVFGFWAFGKHSAAADITSSLSEDQVPGPFLVMVLIQFGTMVVDRALYLRKTVLGKVIFQVILVFGIHFWMFFILPGVTERKFSQNLVAQLWYFVKCVYFGLSAYQIRCGYPTRVLGNFLTKSYNYVNLFLFQGFRLVPFLTELRAVMDWVWTDTTLSLSSWICVEDIYAHIFILKCWRESEKRYPQPRGQKKKKVVKYGMGGMIIVLLICIVWFPLLFMSLIKSVAGVINQPLDVSVTITLGGYQPIFTMSAQQSQLKVMDQQSFNKFIQAFSRDTGAMQFLENYEKEDITVAELEGNSNSLWTISPPSKQKMIHELLDPNSSFSVVFSWSIQRNLSLGAKSEIATDKLSFPLKNITRKNIAKMIAGNSTESSKTPVTIEKIYPYYVKAPSDSNSKPIKQLLSENNFMDITIILSRDNTTKYNSEWWVLNLTGNRIYNPNSQALELVVFNDKVSPPSLGFLAGYGIMGLYASVVLVIGKFVREFFSGISHSIMFEELPNVDRILKLCTDIFLVRETGELELEEDLYAKLIFLYRSPETMIKWTREKTN

SEQ ID NO: 58070 - protein, 854 aa, Homo sapiens
MALRLVADFDLGKDVLPWLRAQRAVSEASGAGSGGADVLENDYESLHVLNVERNGNIIYTYKDDKGNVVFGLYDCQTRQNELLYTFEKDLQVFSCSVNSERTLLAASLVQSTKEGKRNELQPGSKCLTLLVEIHPVNNVKVLKAVDSYIWVQFLYPHIESHPLPENHLLLISEEKYIEQFRIHVAQEDGNRVVIKNSGHLPRDRIAEDFVWAQWDMSEQRLYYIDLKKSRSILKCIQFYADESYNLMFEVPLDISLSNSGFKLVNFGCDYHQYRDKFSKHLTLCVFTNHTGSLCVCYSPKCASWGQITYSVFYIHKGHSKTFTTSLENVGSHMTKGITFLNLDYYVAVYLPGHFFHLLNVQHPDLICHNLFLTGNNEMIDMLPHCPLQSLSGSLVLDCCSGKLYRALLSQSSLLQLLQNTCLDCEKMAALHCALYCGQGAQFLEAQIIQWISENVSACHSFDLIQEFIIASSYWSVYSETSNMDKLLPHSSVLTWNTEIPGITLVTEDIALPLMKVLSFKGYWEKLNSNLEYVKYAKPHFHYNNSVVRREWHNLISEEKTGKRRSAAYVRNILDNAVKVISNLEARNLGPRLTPLLQEEDSHQRLLMGLMVSELKDHFLRHLQGVEKKKIEQMVLDYISKLLDLICHIVETNWRKHNLHSWVLHFNSRGSAAEFAVFHIMTRILEATNSLFLPLPPGFHTLHTILGVQCLPLHNLLHCIDSGVLLLTETAVIRLMKDLDNTEKNEKLKFSIIVRLPPLIGQKICRLWDHPMSSNIISRNHVTRLLQNYKKQPRNSMINKSSFSVEFLPLNYFIEILTDIESSNQALYPFEGHDNVDAEFVEEAALKHTAMLLGL

SEQ ID NO: 58071 - protein, 175 aa, Homo sapiens
MTRILEATNSLFLPLPPGFHTLHTILGVQCLPLHNLLHCIDSGVLLLTETAVIRLMKDLDNTEKNEKLKFSIIVRLPPLIGQKICRLWDHPMSSNIISRNHVTRLLQNYKKQPRNSMINKSSFSVEFLPLNYFIEILTDIESSNQALYPFEGHDNVDAEFVEEAALKHTAMLLGL

SEQ ID NO: 58072 - protein, 290 aa, Homo sapiens
MANPKLLGMGLSEAEAIGADSARFEELLLQASKELQQAQTTRPESTQIQPQPGFCIKTNSSEGKVFINICHSPSIPPPADVTEEELLQMLEEDQAGFRIPMSLGEPHAELDAKGQGCTAYDVAVNSDFYRRMQNSDFLRELVITIAREGLEDKYNLQLNPEWRMMKNRPFMGSISQQNIRSEQRPRIQELGDLYTPAPGRAESGPEKPHLNLWLEAPDLLLAEVDLPKLDGALGLSLEIGENRLVMGGPQQLYHLDAYIPLQINSHESKAAFHRKRKQLMVAMPLLPVPS

SEQ ID NO: 58073 - protein, 313 aa, Homo sapiens
MLLSKINSLAHLRAAPCNDLHATKLAPGKEKEPLESQYQVGPLLGSGGFGSVYSGIRVSDNLPVAIKHVEKDRISDWGELPNGTRVPMEVVLLKKVSSGFSGVIRLLDWFERPDSFVLILERPEPVQDLFDFITERGALQEELARSFFWQVLEAVRHCHNCGVLHRDIKDENILIDLNRGELKLIDFGSGALLKDTVYTDFDGTRVYSPPEWIRYHRYHGRSAAVWSLGILLYDMVCGDIPFEHDEEIIRGQVFFRQRVSSECQHLIRWCLALRPSDRPTFEEIQNHPWMQDVLLPQETAEIHLHSLSPGPSK

SEQ ID NO: 58074 - protein, 311 aa, Homo sapiens
MLTKPLQGPPAPPGTPTPPPGGKDREAFEAEYRLGPLLGKGGFGTVFAGHRLTDRLQVAIKVIPRNRVLGWSPLSDSVTCPLEVALLWKVGAGGGHPGVIRLLDWFETQEGFMLVLERPLPAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSPDCCALIRRCLAPKPSSRPSLEEILLDPWMQTPAEDVPLNPSKGGPAPLAWSLLP

SEQ ID NO: 58075 - protein, 145 aa, Homo sapiens
MLVLERPLPAQDLFDYITEKGPLGEGPSRCFFGQVVAAIQHCHSRGVVHRDIKDENILIDLRRGCAKLIDFGSGALLHDEPYTDFDGTRVYSPPEWISRHQYHALPATVWSLGILLYDMVCGDIPFERDQEILEAELHFPAHVSP

SEQ ID NO: 58076 - protein, 974 aa, Homo sapiens
MAKAGRAGGPPPGGGAPWHLRNVLSDSVESSDDEFFDAREEMAEGKNAILIGMSQWNSNDLVEQIETMGKLDEHQGEGTAPCTSSILQEKQRELYRVSLRRQRFPAQGSIEIHEDSEEGCPQRSCKTHVLLLVLHGGNILDTGAGDPSCKAADIHTFSSVLEKVTRAHFPAALGHILIKFVPCPAICSEAFSLVSHLNPYSHDEGCLSSSQDHVPLAALPLLAISSPQYQDAVATVIERANQVYREFLKSSDGIGFSGQVCLIGDCVGGLLAFDAICYSAGPSGDSPASSSRKGSISSTQDTPVAVEEDCSLASSKRLSKSNIDISSGLEDEEPKRPLPRKQSDSSTYDCEAITQHHAFLSSIHSSVLKDESETPAAGGPQLPEVSLGRFDFDVSDFFLFGSPLGLVLAMRRTVLPGLDGFQVRPACSQVYSFFHCADPSASRLEPLLEPKFHLVPPVSVPRYQRFPLGDGQSLLLADALHTHSPLFLEGSSRDSPPLLDAPASPPQASRFQRPGRRMSEGSSHSESSESSDSMAPVGASRITAKWWGSKRIDYALYCPDVLTAFPTVALPHLFHASYWESTDVVAFILRQVMRYESVNIKESARLDPAALSPANPREKWLRKRTQVKLRNVTANHRANDVIAAEDGPQVLVGRFMYGPLDMVALTGEKVDILVMAEPSSGRWVHLDTEITNSSGRITYNVPRPRRLGVGVYPVKMVVRGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQECFIKISAAYGSTKDISVYSVLGLPASQIFIVGRPTKKYQTQCQFLSEGYAAHLAALEASHRSRPKKNNSRMILRKGSFGLHAQPEFLRKRNHLRRTMSVQQPDPPAANPKPERAQSQPESDKDHERPLPALSWARGPPKFESVP

SEQ ID NO: 58077 - protein, 938 aa, Homo sapiens
MAKAGRAGGPPPGGGAPWHLRNVLSDSVESSDDEFFDARGEGTAPCTSSILQEKQRELYRVSLRRQRFPAQGSIEIHEDSEEGCPQRSCKTHVLLLVLHGGNILDTGAGDPSCKAADIHTFSSVLEKVTRAHFPAALGHILIKFVPCPAICSEAFSLVSHLNPYSHDEGCLSSSQDHVPLAALPLLAISSPQYQDAVATVIERANQVYREFLKSSDGIGFSGQVCLIGDCVGGLLAFDAICYSAGPSGDSPASSSRKGSISSTQDTPVAVEEDCSLASSKRLSKSNIDISSGLEDEEPKRPLPRKQSDSSTYDCEAITQHHAFLSSIHSSVLKDESETPAAGGPQLPEVSLGRFDFDVSDFFLFGSPLGLVLAMRRTVLPGLDGFQVRPACSQVYSFFHCADPSASRLEPLLEPKFHLVPPVSVPRYQRFPLGDGQSLLLADALHTHSPLFLEGSSRDSPPLLDAPASPPQASRFQRPGRRMSEGSSHSESSESSDSMAPVGASRITAKWWGSKRIDYALYCPDVLTAFPTVALPHLFHASYWESTDVVAFILRQVMRYESVNIKESARLDPAALSPANPREKWLRKRTQVKLRNVTANHRANDVIAAEDGPQVLVGRFMYGPLDMVALTGEKVDILVMAEPSSGRWVHLDTEITNSSGRITYNVPRPRRLGVGVYPVKMVVRGDQTCAMSYLTVLPRGMECVVFSIDGSFAASVSIMGSDPKVRPGAVDVVRHWQDLGYMILYITGRPDMQKQRVVSWLSQHNFPQGMIFFSDGLVHDPLRQKAIFLRNLMQECFIKISAAYGSTKDISVYSVLGLPASQIFIVGRPTKKYQTQCQFLSEGYAAHLAALEASHRSRPKKNNSRMILRKGSFGLHAQPEFLRKRNHLRRTMSVQQPDPPAANPKPERAQSQPESDKDHERPLPALSWARGPPKFESVP

SEQ ID NO: 58078 - protein, 202 aa, Homo sapiens
MATLIYVDKENGEPGTRVVAKDGLKLGSGPSIKALDGRSQVSTPRFGKTFDAPPALPKATRKALGTVNRATEKSVKTKGPLKQKQPSFSAKKMTEKTVKAKSSVPASDDAYPEIEKFFPFNPLDFESFDLPEEHQIAHLPLSGVPLMILDEERELEKLFQLGPPSPVKMPSPPWESNLLQSPSSILSTLDVELPPVCCDIDI

SEQ ID NO: 58079 - protein, 202 aa, Homo sapiens; identical to SEQ ID NO: 58078

SEQ ID NO: 58080 - protein, 202 aa, Homo sapiens; identical to SEQ ID NO: 58078

SEQ ID NO: 58081 - protein, 180 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 58082 - protein, 142 aa, Homo sapiens
MAPGVARGPTPYWRLRLGGAALLLLLIPVAAAQEPPGAACSQNTNKTCEECLKNVSACLKKKTRMLDLKTTKALQHISPDASCEVHAPQPSPAGRPRGHCGLLTLASEPASLPGQAAGELPLKDSPLVLQTGDLLFPVHLCF

SEQ ID NO: 58083 - protein, 191 aa, Homo sapiens
MATLIYVDKEIGEPGTRVAAKDVLKLESRPSIKALDGISQVLTRRFGKTYDAPSALPKATRKALGTVNRATEKSVKTNGPRKQKQPSFSAKKMTEKTVKTKSSVPASDDAYPEIEKFFPFNLLDFESFDLPEERQIAHLPLSGVPLMILDEEGELEKLFQLGPPSPVKMPSPPWECNLFAVSFKHSVDPGC

SEQ ID NO: 58084 - protein, 861 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPKRLQQKVTEVFSKTRNGEDVRITITLTNELPPTSPTCLQFYNIIFRRLLKIMNLQQIGRNYYNPNDPIDIPSHRLVIWPGFTTSILQYENSIMLCTDVSHKVLRSETVLDFMFNFYHQTEEHKFQEQVSKELIGLVVLTKYNNKTYRVDDIDWDQNPKSTFKKADGSEVSFLEYYRKQYNQEITDLKQPVLVSQPKRRRGPGGTLPGPAMLIPELCYLTGLTDKMRNDFNVMKDLAVHTRLTPEQRQREVGRLIDYIHKNDNVQRELRDWGLSFDSNLLSFSGRILQTEKIHQGGKTFDYNPQFADWSKETRGAPLISVKPLDNWLLIYTRRNYEAANSLIQNLFKVTPAMGMQMRKAIMIEVDDRTEAYLRVLQQKVTADTQIVVCLLSSNRKDKYDAIKKYLCTDCPTPSQCVVARTLGKQQTVMAIATKIALQMNCKMGGELWRVDIPLKLVMIVGIDCYHDMTAGRRSIAGFVASINEGMTRWFSRCIFQDRGQELVDGLKVCLQAALRAWNSCNEYMPSRIIVYRDGVGDGQLKTLVNYEVPQFLDCLKSIGRGYNPRLTVIVVKKRVNTRFFAQSGGRLQNPLPGTVIDVEVTRPEWYDFFIVSQAVRSGSVSPTHYNVIYDNSGLKPDHIQRLTYKLCHIYYNWPGVIRVPAPCQYAHKLAFLVGQSIHREPNLSLSNRLYYL

SEQ ID NO: 58085 - protein, 122 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLT

SEQ ID NO: 58086 - protein, 150 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALL

SEQ ID NO: 58087 - protein, 172 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDGTILFLPK

SEQ ID NO: 58088 - protein, 165 aa, Homo sapiens
MTGRARARARGRARGQETAQLVGSTASQQPGYIQPRPQPPPAEGELFGRGRQRGTAGGTAKSQGLQISAGFQELSLAERGGRRRDFHDLGVNTRQNLDHVKESKTGSSGIIVRLSTNHFRLTSRPQWALYQYHIDYNPLMEARRLRSALLFQHEDLIGKCHAFDG

SEQ ID NO: 58089 - protein, 973 aa, Homo sapiens
MDPFRPSFRGQSPIHPSQCQAVRMPGCWPQASKPLDPALGRGAPAGRGHVFGKPEEPSTQRGPAQRESVGLVSMFRGLGIETVSKTPLKREMLPSGRGILGRGLSANLVRKDREELSPTFWDPKVLAAGDSKMAETSVGWSRTLGRGSSDASLLPLGRAAGGISREVDKPPCTFSTPSRGPPQLSSPPALPQSPLHSPDRPLVLTVEHKEKELIVKQGSKGTPQSLGLNLVKIQCHNEAVYQYHVTFSPNVECKSMRFGMLKDHQAVTGNVTAFDGSILYLPVKLQQVLELKSQRKTDSAEISIKIQMTKILEPCSDLCIPFYNVVFRRVMKLLDMKLVGRNFYDPTSAMVLQQHRLQIWPGYAASIRRTDGGLFLLADVSHKVIRNDCVLDVMHAIYQQNKEHFQDECTKLLVGNIVITRYNNRTYRIDDVDWNKTPKDSFTMSDGKEITFLEYYSKNYGITVKEEDQPLLIHRPSERQDNHGMLLKGEILLLPELSFMTGIPEKMKKDFRAMKDLAQQINLSPKQHHSALECLLQRIAKNEAATNELMRWGLRLQKDVHKIEGRVLPMERINLKNTSFITSQELNWVKEVTRDPSILTIPMHFWALFYPKRAMDQARELVNMLEKIAGPIGMRMSPPAWVELKDDRIETYVRTIQSTLGAEGKIQMVVCIIMGPRDDLYGAIKKLCCVQSPVPSQVVNVRTIGQPTRLRSVAQKILLQINCKLGGELWGVDIPLKQLMVIGMDVYHDPSRGMRSVVGFVASINLTLTKWYSRVVFQMPHQEIVDSLKLCLVGSLKKFYEVNHCLPEKIVVYRDGVSDGQLKTVANYEIPQLQKCFEAFENYQPKMVVFVVQKKISTNLYLAAPQNFVTPTPGTVVDHTITSCEWVDFYLLAHHVRQGCGIPTHYVCVLNTANLSPDHMQRLTFKLCHMYWNWPGTIRVPAPCKYAHKLAFLSGHILHHEPAIQLCENLFFL

SEQ ID NO: 58090 - protein, 973 aa, Homo sapiens; identical to SEQ ID NO: 58089

SEQ ID NO: 58091 - protein, 212 aa, Homo sapiens
MKVFKFIGLMILLTSAFSAGSGQSPMTVLCSIDWFMVTVHPFMLNNDVCVHFHELHLGLGCPPNHVQPHAYQFTYRVTECGIRAKAVSQDMVIYSTEIHYSSKGTPSKFVIPVSCAAPQKSPWLTKPCSMRVASKSRATAQKDEKCYEVFSLSQSSQRPNCDCPPCVFSEEEHTQVPCHQAGAQEAQPLQPSHFLDISEDWSLHTDDMIGSM

SEQ ID NO: 58092 - protein, 97 aa, Homo sapiens
MRPLLCALTGLALLRAAGSLAAAEPFSPPRGDSAQSTACDRHMAVQRRLDVMEEMVEKTVDHLGTEVKGLLGLLEELAWNLPPGPFSPAPDLLGDGF

SEQ ID NO: 58093 - protein, 87 aa, Homo sapiens
MRPLLCALTGLALLRAAGSLAAAEPFSPPRGDSAQSTACDRHMAVQRRLDVMEEMASEPWSWSPAVGGGAPARQRPQNQPCPLDFLP

SEQ ID NO: 58094 - protein, 55 aa, Homo sapiens
MAVQRRLDVMEEMVEKTVDHLGTEVKGLLGLLEELAWNLPPGPFSPAPDLLGDGF

SEQ ID NO: 58095 - protein, 747 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRKRLGMRELLALVPQRATSSRVNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 58096 - protein, 747 aa, Homo sapiens; identical to SEQ ID NO: 58095

SEQ ID NO: 58097 - protein, 726 aa, Homo sapiens
MNHSPLKTALAYECFQDQDNSTLALPSDQKMKTGTSGRQRVQEQVMMTVKRQKSKSSQSSTLSHSNRGSMYDGLADNYNYGTTSRSSYYSKFQAGNGSWGYPIYNGTLKREPDNRRFSSYSQMENWSRHYPRGSCNTTGAGSDICFMQKIKASRSEPDLYCDPRGTLRKGTLGSKGQKTTQNRYSFYSTCSGQKAIKKCPVRPPSCASKQDPVYIPPISCNKDLSFGHSRASSKICSEDIECSGLTIPKAVQYLSSQDEKYQAIGAYYIQHTCFQDESAKQQVYQLGGICKLVDLLRSPNQNVQQAAAGALRNLVFRSTTNKLETRRQNGIREAVSLLRRTGNAEIQKQLTGLLWNLSSTDELKEELIADALPVLADRVIIPFSGWCDGNSNMSREVVDPEVFFNATGCLRNLSSADAGRQTMRNYSGLIDSLMAYVQNCVAASRCDDKSVENCMCVLHNLSYRLDAEVPTRYRQLEYNARNAYTEKSSTGCFSNKSDKMMNNNYDCPLPEEETNPKGSGWLYHSDAIRTYLNLMGKSKKDATLEACAGALQNLTASKGLMSSGMSQLIGLKEKGLPQIARLLQSGNSDVVRSGASLLSNMSRHPLLHRVMGNQVFPEVTRLLTSHTGNTSNSEDILSSACYTVRNLMASQPQLAKQYFSSSMLNNIINLCRSSASPKAAEAARLLLSDMWSSKELQGVLRQQGFDRNMLGTLAGANSLRNFTSRF

SEQ ID NO: 58098 - protein, 881 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITDHTVNLRSRNGWPGAVAHACNPSTLGGQGGRITRSGVRDQPDQHGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 58099 - protein, 837 aa, Homo sapiens
MAAPGAPAEYGYIRTVLGQQILGQLDSSSLALPSEAKLKLAGSSGRGGQTVKSLRIQEQVQQTLARKGRSSVGNGNLHRTSSVPEYVYNLHLVENDFVGGRSPVPKTYDMLKAGTTATYEGRWGRGTAQYSSQKSVEERSLRHPLRRLEISPDSSPERAHYTHSDYQYSQRSQAGHTLHHQESRRAALLVPPRYARSEIVGVSRAGTTSRQRHFDTYHRQYQHGSVSDTVFDSIPANPALLTYPRPGTSRSMGNLLEKENYLTAGLTVGQVRPLVPLQPVTQNRASRSSWHQSSFHSTRTLREAGPSVAVDSSGRRAHLTVGQAAAGGSGNLLTERSTFTDSQLGNADMEMTLERAVSMLEADHMLPSRISAAATFIQHECFQKSEARKRVNQLRGILKLLQLLKVQNEDVQRAVCGALRNLVFEDNDNKLEVAELNGVPRLLQVLKQTRDLETKKQITGLLWNLSSNDKLKNLMITEALLTLTENIIIPFSGWPEGDYPKANGLLDFDIFYNVTGCLRNMSSAGADGRKAMRRCDGLIDSLVHYVRGTIADYQPDDKATENCVCILHNLSYQLEAELPEKYSQNIYIQNRNIQTDNNKSIGCFGSRSRKVKEQYQDVPMPEEKSNPKGVEWLWHSIVIRMYLSLIAKSVRNYTQEASLGALQNLTAGSGPMPTSVAQTVVQKESGLQHTRKMLHVGDPSVKKTAISLLRNLSRNLSLQNEIAKETLPDLVSIIPDTVPSTDLLIETTASACYTLNNIIQNSYQNARDLLNTGGIQKIMAISAGDAYASNKASKAASVLLYSLWAHTELHHAYKKAQFKKTDFVNSRTAKAYHSLKD

SEQ ID NO: 58100 - protein, 824 aa, Homo sapiens [sequence omitted]

SEQ ID NO: 58101 - protein, 797 aa, Homo sapiens
MQDGNFLLSALQPEAGVCSLALPSDLQLDRRGAEGPEAERLRAARVQEQVRARLLQLGQQPRHNGAAEPEPEAETARGTSRGQYHTLQAGFSSRSQGLSGDKTSGFRPIAKPAYSPASWSSRSAVDLSCSRRLSSAHNGGSAFGAAGYGGAQPTPPMPTRPVSFHERGGVGSRADYDTLSLRSLRLGPGGLDDRYSLVSEQLEPAATSTYRAFAYERQASSSSSRAGGLDWPEATEVSPSRTIRAPAVRTLQRFQSSHRSRGVGGAVPGAVLEPVARAPSVRSLSLSLADSGHLPDVHGFNSYGSHRTLQRLSSGFDDIDLPSAVKYLMASDPNLQVLGAAYIQHKCYSDAAAKKQARSLQAVPRLVKLFNHANQEVQRHATGAMRNLIYDNADNKLALVEENGIFELLRTLREQDDELRKNVTGILWNLSSSDHLKDRLARDTLEQLTDLVLSPLSGAGGPPLIQQNASEAEIFYNATGFLRNLSSASQATRQKMRECHGLVDALVTSINHALDAGKCEDKSVENAVCVLRNLSYRLYDEMPPSALQRLEGRGRRDLAGAPPGEVVGCFTPQSRRLRELPLAADALTFAEVSKDPKGLEWLWSPQIVGLYNRLLQRCELNRHTTEAAAGALQNITAGDRRWAGVLSRLALEQERILNPLLDRVRTADHHQLRSLTGLIRNLSRNARNKDEMSTKVVSHLIEKLPGSVGEKSPPAEVLVNIIAVLNNLVVASPIAARDLLYFDGLRKLIFIKKKRDSPDSEKSSRAASSLLANLWQYNKLHRDFRAKGYRKEDFLGP

SEQ ID NO: 58102 - protein, 91 aa, Homo sapiens
TAFRRTPGEEFAWRDPELPEVIHMLQHQFPSVQANAAAYLQHLCFGDNKVKMEVCRLGGIKHLVDLLDHRVGSSEECLWCPSKPRFWQVYR

SEQ ID NO: 58103 - protein, 1149 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSVGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 58104 - protein, 1192 aa, Homo sapiens
MPAPEQASLVEEGQPQTRQEAASTGPGMEPETTATTILASVKEQELQFQRLTRELEVERQIVASQLERCRLGAESPSIASTSSTEKSFPWRSTDVPNTGVSKPRVSDAVQPNNYLIRTEPEQGTLYSPEQTSLHESEGSLGNSRSSTQMNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTGLRSSYASQHSQLGQDLRSAVSPDLHITPIYEGRTYYSPVYRSPNHGTVELQGSQTALYRTGSVGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLSYRLELEVPQARLLGLNELDDLLGKESPSKDSEPSCWGKKKKKKKRTPQEDQWDGVGPIPGLSKSPKGVEMLWHPSVVKPYLTLLAESSNPATLEGSAGSLQNLSAGNWKFAAYIRAAVRKEKGLPILVELLRMDNDRVVSSVATALRNMALDVRNKELIGKYAMRDLVNRLPGGNGPSVLSDETMAAICCALHEVTSKNMENAKALADSGGIEKLVNITKGRGDRSSLKVVKAAAQVLNTLWQYRDLRSIYKKDGWNQNHFITPVSTLERDRFKSHPSLSTTNQQMSPIIQSVGSTSSSPALLGIRDPRSEYDRTQPPMQYYNSQGDATHKGLYPGSSKPSPIYISSYSSPAREQNRRLQHQQLYYSQDDSNRKNFDAYRLYLQSPHSYEDPYFDDRVHFPASTDYSTQYGLKSTTNYVDFYSTKRPSYRAEQYPGSPDSWV

SEQ ID NO: 58105 - protein, 614 aa, Homo sapiens
MNSYSDSGYQEAGSFHNSQNVSKADNRQQHSFIGSTNNHVVRNSRAEGQTLVQPSVANRAMRRVSSVPSRAQSPSYVISTGVSPSRGSLRTSLGSGFGSPSVTDPRPLNPSAYSSTTLPAARAASPYSQRPASPTAIRRIGSVTSRQTSNPNGPTPQYQTTARVGSPLTLTDAQTRVASPSQGQVGSSSPKRSGMTAVPQHLGPSLQRTVHDMEQFGQQQYDIYERMVPPRPDSLTAYGVPMLVSIVSLGKTFVLPCPDLHITPIYEGRTYYSPVYRSPNHGTVELQGSQTALYRTGSVGIGNLQRTSSQRSTLTYQRNNYALNTTATYAEPYRPIQYRVQECNYNRLQHAVPADDGTTRSPSIDSIQKDPREFAWRDPELPEVIHMLQHQFPSVQANAAAYLQHLCFGDNKVKMEVCRLGGIKHLVDLLDHRVLEVQKNACGALRNLVFGKSTDENKIAMKNVGGIPALLRLLRKSIDAEVRELVTGVLWNLSSCDAVKMTIIRDALSTLTNTVIVPHSGWNNSSFDDDHKIKFQTSLVLRNTTGCLRNLSSAGEEARKQMRSCEGLVDSLLYVIHTCVNTSDYDSKTVENCVCTLRNLIGWSWRCPRPGYWD

SEQ ID NO: 58106 - protein, 442 aa, Homo sapiens
MGLAMEHGGSYARAGGSSRGCWYYLRYFFLFVSLIQFLIILGLVLFMVYGNVHVSTESNLQATERRAEGLYSQLLGLTASQSNLTKELNFTTRAKDAIMQMWLNARRDLDRINASFRQCQGDRVIYTNNQRYMAAIILSEKQCRDQFKDMNKSCDALLFMLNQKVKTLEVEIAKEKTICTKDKESVLLNKRVAEEQLVECVKTRELQHQERQLAKEQLQKVQALCLPLDKDKFEMDLRNLWRDSIIPRSLDNLGYNLYHPLGSELASIRRACDHMPSLMSSKVEELARSLRADIERVARENSDLQRQKLEAQQGLRASQEAKQKVEKEAQAREAKLQAECSRQTQLALEEKAVLRKERDNLAKELEEKKREAEQLRMELAIRNSALDTCIKTKSQPMMPVSRPMGPVPNPQPIDPASLEEFKRKILESQRPPAGIPVAPSSG

SEQ ID NO: 58107 - protein, 96 aa, Homo sapiens
MEHKEVVLLLLLFLKSGQGEPLDDYVNTQGPSLFSVTKKQLGAGSREECAAKCEEDKEFTCRAFQYHSKEQQCVIMAENRKSSIIIRMRDAVLFEK

SEQ ID NO: 58108 - protein, 96 aa, Homo sapiens; identical to SEQ ID NO: 58107

SEQ ID NO: 58109 - protein, 96 aa, Homo sapiens; identical to SEQ ID NO: 58107

SEQ ID NO: 58110 - protein, 182 aa, Homo sapiens
MAEFPSKVSTRTSSPAQGAEASVSALRPDLGFVRSRLGALMLLQLVLGLLVWALIADTPYHLYPAYGWVMFVAVFLWLVTIVLFNLYLFQLHMKLYMVPWPLVLMIFNISATVLYITAFIACSAAVDLTSLRGTRPYNQRAAASFFACLVMIAYGVSAFFSYQAWRGVGSNAATSQMAGGYA

SEQ ID NO: 58111 - protein, 629 aa, Homo sapiens
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHSYSEEEKVAFVNWINKALENDPDCKHLIPMNPNDDSLFKSLADGILLCKMINLSEPDTIDERAINKKKLTPFTISENLNLALNSASAIGCTVVNIGASDLKEGKPHLVLGLLWQIIKVGLFADIEISRNEALIALLNEGEELEELMKLSPEELLLRWVNYHLTNAGWHTISNFSQDIKDSRAYFHLLNQIAPKGGEDGPAIAIDLSGINETNDLKRAGLMLQEADKLGCKQFVTPADVVSGNPKLNLAFVANLFNTYPCLHKPNNNDIDMNLLEGESKEERTFRNWMNSLGVNPYINHLYSDLADALVIFQLYEMIRVPVNWSHVNKPPYPALGGNMKKIENCNYAVELGKNKAKFSLVGIAGQDLNEGNSTLTLALVWQLMRRYTLNVLSDLGEGEKVNDEIIIKWVNQTLKSANKKTSISSFKDKSISTSLPVLDLIDAIAPNAVRQEMIRRENLSDEDKLNNAKYAISVARKIGARIYALPDDLVEVKPKMVMTVFACLMGKGLNRIK

SEQ ID NO: 58112 - protein, 629 aa, Homo sapiens; identical to SEQ ID NO: 58111

SEQ ID NO: 58113 - protein, 54 aa, Homo sapiens
MENSTTTISREELEELQEAFNKIDIDNSGYVSDYELQDLFKEASLPLPGYKVRE

SEQ ID NO: 58114 - protein, 120 aa, Homo sapiens
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHSY

SEQ ID NO: 58115 - protein, 119 aa, Homo sapiens
MENSTTTISREELEELQEAFNKIDIDNSGYVSDYELQDLFKEASLPLPGYKVREIVEKILSVADSNKDGKISFEEFVSLMQELKSKDISKTFRKIINKREGITAIGGTSTISSEGTQHS

SEQ ID NO: 58116 - protein, 33 aa, Homo sapiens
MENSTTTISREELEELQEAFNKIDIDNSGYVSD

SEQ ID NO: 58117 - protein, 58 aa, Homo sapiens
MENSTTTISREELEELQEAFNKIDIDNSGYVSDYELQDLFKEASLPLPGYKVREIVEK

SEQ ID NO: 58118 - protein, 629 aa, Homo sapiens; identical to SEQ ID NO: 58111

SEQ ID NO: 58119 - protein, 53 aa, Homo sapiens
MENSTTTISREELEELQEAFNKIDIDNSGYVSDYELQDLFKEASLPLPGYKVR

SEQ ID NO: 58120 - protein, 594 aa, Homo sapiens
MPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKLIDFSNSVKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 58121 - protein, 630 aa, Homo sapiens
MDEMATTQISKDELDELKEAFAKVDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 58122 - protein, 630 aa, Homo sapiens; identical to SEQ ID NO: 58121

SEQ ID NO: 58123 - protein, 617 aa, Homo sapiens
MEDLNSNGFICDYELHELFKEANMPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKLIDFSNSVKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 58124 - protein, 585 aa, Homo sapiens
MPLPGYKVREIIQKLMLDGDRNKDGKISFDEFVYIFQEVKSSDIAKTFRKAINRKEGICALGGTSELSSEGTQHSYSEEEKYAFVNWINKALENDPDCRHVIPMNPNTDDLFKAVGDGIVLCKMINLSVPDTIDERAINKKKLTPFIIQENLNLALNSASAIGCHVVNIGAEDLRAGKPHLVLGLLWQIIKIGLFADIELSRNEALAALLRDGETLEELMKLSPEELLLRWANFHLENSGWQKINNFSADIKDSKAYFHLLNQIAPKGQKEGEPRIDINMSGFNETDDLKRAESMLQQADKLGCRQFVTPADVVSGNPKLNLAFVANLFNKYPALTKPENQDIDWTLLEGETREERTFRNWMNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 58125 - protein, 224 aa, Homo sapiens
MNSLGVNPHVNHLYADLQDALVILQLYERIKVPVDWSKVNKPPYPKLGANMKKLENCNYAVELGKHPAKFSLVGIGGQDLNDGNQTLTLALVWQLMRRYTLNVLEDLGDGQKANDDIIVNWVNRTLSEAGKSTSIQSFKDKTISSSLAVVDLIDAIQPGCINYDLVKSGNLTEDDKHNNAKYAVSMARRIGARVYALPEDLVEVKPKMVMTVFACLMGRGMKRV

SEQ ID NO: 58126 - protein, 101 aa, Homo sapiens
MSSAAGFCASRPGLLFLGLLLLPLVVAFASAEAEEDGDLQCLCVKTTSQVRPRHITSLEVIKAGPHCPTAQLIATLKNGRKICLDLQAPLYKKIIKKLLES

SEQ ID NO: 58127 - protein, 104 aa, Homo sapiens
MSSAARSRLTRATRQEMLFLALLLLPVVVAFARAEAEEDGDLQCLCVKTTSQVRPRHITSLEVIKAGPHCPTAQLIATLKNGRKICLDLQALLYKKIIKEHLES

SEQ ID NO: 58128 - protein, 132 aa, Homo sapiens
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQA

SEQ ID NO: 58129 - protein, 229 aa, Homo sapiens
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLGLLPRGEKPNPLRQKNAKVNQLLKVSLPKLANVQLLDTDGGFVHSDGAISCHDMFDFLHLTGGGYAKICKPLHELIMQLLEETPEEKQTTIA

SEQ ID NO: 58130 - protein, 155 aa, Homo sapiens
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLIIYWQDEQDYHERKVQMD

SEQ ID NO: 58131 - protein, 202 aa, Homo sapiens
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLGKAAASKYSISEIVRLEQGSVNWSIGTYPDDTPATTRPAILQLFTGKMSRITMKEKSRWTEEILH

SEQ ID NO: 58132 - protein, 231 aa, Homo sapiens
MSGEENPASKPTPVQDVQGDGRWMSLHHRFVADSKDKEPEVVFIGDSLVQLMHQCEIWRELFSPLHALNFGIGGDGTQHVLWRLENGELEHIRPKIVVVWVGTNNHGHTAEQVTGGIKAIVQLVNERQPQARVVVLGLLPRGQHPNPLREKNRQVNELVRAALAGHPRAHFLDADPGFVHSDGTISHHDMYDYLHLSRLGYTPVCRALHSLLLRLLAQDQGQGAPLLEPAP

SEQ ID NO: 58133 - protein, 231 aa, Homo sapiens; identical to SEQ ID NO: 58132

SEQ ID NO: 58134 - protein, 239 aa, Homo sapiens
MTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 58135 - protein, 410 aa, Homo sapiens
MVLSQRQRDELNRAIADYLRSNGYEEAYSVFKKEAELDVNEELDKKYAGLLEKKWTSVIRLQKKVMELESKLNEAKEEFTSGGPLGQKRDPKEWIPRPPEKYALSGHRSPVTRVIFHPVFSVMVSASEDATIKVWDYETGDFERTLKGHTDSVQDISFDHSGKLLASCSADMTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSETKKSGKPGPFLLSGSRDKTIKMWDVSTGMCLMTLVGHDNWVRGVLFHSGGKFILSCADDKTLRVWDYKNKRCMKTLNAHEHFVTSLDFHKTAPYVVTGSVDQTVKVWECR

SEQ ID NO: 58136 - protein, 205 aa, Homo sapiens
MTIKLWDFQGFECIRTMHGHDHNVSSVAIMPNGDHIVSASRDKTIKMWEVQTGYCVKTFTGHREWVRMVRPNQDGTLIASCSNDQTVRVWVVATKECKAELREHEHVVECISWAPESSYSSISEATGSEVGHDNWVRGVLFHSGGKFILSCADDKTLRVWDYKNKRCMKTLNAHEHFVTSLDFHKTAPYVVTGSVDQTVKVWECR

SEQ ID NO: 58137 - protein, 342 aa, Homo sapiens
MEPHDSSHMDSEFRYTLFPIVYSIIFVLGVIANGYVLWVFARLYPCKKFNEIKIFMVNLTMADMLFLITLPLWIVYYQNQGNWILPKFLCNVAGCLFFINTYCSVAFLGVITYNRFQAVTRPIKTAQANTRKRGISLSLVIWVAIVGAASYFLILDSTNTVPDSAGSGNVTRCFEHYEKGSVPVLIIHIFIVFSFFLVFLIILFCNLVIIRTLLMQPVQQQRNAEVKRRALWMVCTVLAVFIICFVPHHVVQLPWTLAELGFQDSKFHQAINDAHQVTLCLLSTNCVLDPVIYCFLTKKFRKHLTEKFYSMRSSRKCSRATTDTVTEVVVPFNQIPGNSLKN

SEQ ID NO: 58138 - protein, 342 aa, Homo sapiens; identical to SEQ ID NO: 58137

SEQ ID NO: 58139 - protein, 342 aa, Homo sapiens; identical to SEQ ID NO: 58137

SEQ ID NO: 58140 - protein, 375 aa, Homo sapiens
MKVWLLLGLLLVHEALEDVTGQHLPKNKRPKEPGENRIKPTNKKVKPKIPKMKDRDSANSAPKTQSIMMQVLDKGRFQKPAATLSLLAGQTVELRCKGSRIGWSYPAYLDTFKDSRLSVKQNERYGQLTLVNSTSADTGEFSCWVQLCSGYICRKDEAKTGSTYIFFTEKGELFVPSPSYFDVVYLNPDRQAVVPCRVTVLSAKVTLHREFPAKEIPANGTDIVYDMKRGFVYLQPHSEHQGVVYCRAEAGGRSQISVKYQLLYVAVPSGPPSTTILASSNKVKSGDDISVLCTVLGEPDVEVEFTWIFPGQKDERPVTIQDTWRLIHRGLGHTTRISQSVITVEDFETIDAGYYICTAQNLQGQTTVATTVEFS

SEQ ID NO: 58141 - protein, 375 aa, Homo sapiens; identical to SEQ ID NO: 58140

SEQ ID NO: 58142 - protein, 375 aa, Homo sapiens; identical to SEQ ID NO: 58140

SEQ ID NO: 58143 - protein, 1024 aa, Homo sapiens
MAQGAMRFCSEGDCAISPPRCPRRWLPEGPVPQSPPASMYGSTGSLLRRVAGPGPRGRELGRVTAPCTPLRGPPSPRVAPSPWAPSSPTGQPPPGAQSSVVIFRFVEKASVRPLNGLPAPGGLSRSWDLGGVSPPRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLTCALMLLNTDLHGHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 58144 - protein, 1024 aa, Homo sapiens; identical to SEQ ID NO: 58143

SEQ ID NO: 58145 - protein, 927 aa, Homo sapiens
QIWRCPLQHHAESAPPLPALSWAQPLLCLSSVSALGEQRPTPALGPGSNRKLRLEASTSDPLPARGGSALPGSRNLVHGPPAPPQVGADGLYSSLPNGLGGPPERLATLFGGPADTGFLNQGDTWSSPREVSSHAQRIARAKWEFFYGSLDPPSSGAKPPEQAPPSPPGVGSRQGSGVAVGRAAKYSETDLDTVPLRCYRETDIDEVLAEREEADSAIESQPSSEGPPGTAYPPAPRPGPLPGPHPSLGSGNEDEDDDEAGGEEDVDDEVFEASEGARPGSRMPLKSPVPFLPGTSPSADGPDSFSCVFEAILESHRAKGTSYTSLASLEALASPGPTQSPFFTFELPPQPPAPRPDPPAPAPLAPLEPDSGTSSAADGPWTQRGEEEEAEARAKLAPGREPPSPCHSEDSLGLGAAPLGSEPPLSQLVSDSDSELDSTERLALGSTDTLSNGQKADLEAAQRLAKRLYRLDGFRKADVARHLGKNNDFSKLVAGEYLKFFVFTGMTLDQALRVFLKELALMGETQERERVLAHFSQRYFQCNPEALSSEDGAHTLTCALMLLNTDLHGHNIGKRMTCGDFIGNLEGLNDGGDFPRELLKALYSSIKNEKLQWAIDEEELRRSLSELADPNPKVIKRISGGSGSGSSPFLDLTPEPGAAVYKHGALVRKVHADPDCRKTPRGKRGWKSFHGILKGMILYLQKEEYKPGKALSETELKNAISIHHALATRASDYSKRPHVFYLRTADWRVFLFQAPSLEQMQSWITRINVVAAMFSAPPFPAAVSSQKKFSRPLLPSAATRLSQEEQVRTHEAKLKAMASELREHRAAQLGKKGRGKEAEEQRQKEAYLEFEKSRYSTYAALLRVKLKAGSEELDAVEAALAQAGSTEDGLPPSHSSPSLQPKPSSQPRAQRHSSEPRPGAGSGRRKP

SEQ ID NO: 58146 - protein, 513 aa, Homo sapiens
MGSSWCLYGCCNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 58147 - protein, 1047 aa, Homo sapiens
MEGRSAAAETFVWVNNASAHSQSVAKAKYEFLFGRSEGKAPDTSDHGGSTLLPPNVTNEFPEYGTMEEGGEGLRASLEFDGEALPCHPQEQQGVQPLTGCHSGLDSVTEGPKDVREAPSQSHLKEQSLQPIDSLISALKATEARIISGTLQATKVLDQDAVSSFSVQQVEKELDTASRKTQRVNKTLPAGQKNLPEIPLSAEVTTEESFYLSIQKDLTALLTGDTQAEISQIMNNGRKGAVCVQEPSCPLASLGSSAVTCHSAGSVGFLKEQRSALGREHPGGCDRSSSMGRPGRVKHVEFQGVEILWTGGDKRETQHPIDFETSLQRTASPDSKESSKVPRHLISSAGLCNSSSLTENVWDESWKAPSERPGTSSGTFSPVRLDESGEDEVFLQENKQHLEKTPKPERDRERISEQEEHVKGEDEDILGPGYTEDSTDVYSSQFETILDNTSLYYSAESLETLYSEPDSYFSFEMPLTPMIQQRIKEGGQFLERTSGGGHQDILSVSADGGIVMGYSSGVTNGLNDASDSIYTKGTPEIAFWGSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 58148 - protein, 269 aa, Homo sapiens
MIGVNSVQSASKVRVRTSGSVKYSREDSIRRQSHRSKSMKISNSSEFSAKENKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 58149 - protein, 1049 aa, Homo sapiens
MEGRSAAAETFVWVNNASAHSQSVAKAKYEFLFGRSEGKAPDTSDHGGSTLLPPNVTNEFPEYGTMEEGGEGLRASLEFDGEALPCHPQEQQGVQPLTGCHSGLDSVTEGPKDVREAPSQSHLKEQSLQPIDSLISALKATEARIISGTLQATKVLDQDAVSSFSVQQVEKELDTASRKTQRVNKTLPAGQKNLPEIPLSAEVTTEESFYLSIQKDLTALLTGDTQAEISQIMNNGRKGAVCVQEPSCPLASLGSSAVTCHSAGSVGFLKEQRSALGREHPGGCDRSSSMGRPGRVKHVEFQGVEILWTGGDKRETQHPIDFETSLQRTASPDSKESSKVPRHLISSAGLCNSSSLTENVWDESWKAPSERPGTSSGTFSPVRLDESGEDEVFLQENKQHLEKTPKPERDRERISEQEEHVKGEDEDILGPGYTEDSTDVYSSQFETILDNTSLYYSAESLETLYSEPDSYFSFEMPLTPMIQQRIKEGGQFLERTSGGGHQDILSVSADGGIVMGYSSGVTNGLNDASDSIYTKGTPEIAFWGSNAGVKTTRLEAHSEMGSTEILEKETPENLSNGTSSNVEAAKRLAKRLYQLDRFKRSDVAKHLGKNNEFSKLVAEEYLKFFDFTGMTLDQSLRYFFKAFSLVGETQERERVLIHFSNRYFYCNPDTIASQDGVHCLTCAIMLLNTDLHGHVSNIGKKMTCQEFIANLQGVNEGVDFSKDLLKALYNSIKNEKLEWAVDDEEKKKSPSESTEEKANGTHPKTISRIGSTTNPFLDIPHDPNAAVYKSGFLARKIHADMDGKKTPRGKRGWKTFYAVLKGTVLYLQKDEYKPEKALSEEDLKNAVSVHHALASKATDYEKKPNVFKLKTADWRVLLFQTQSPEEMQGWINKINCVAAVFSAPPFPAAIGSQKKFSRPLLPATTTKLSQEEQLKSHESKLKQITTELAEHRSYPPDKKVKAKDVDEYKLKDHYLEFEKTRYEMYVSILKEGGKELLSNDESEAAGLKKSHSSPSLNPDTSPITAKVKRNVSERKDHRPETPSIKQKVT

SEQ ID NO: 58150 - protein, 1056 aa, Homo sapiens
MMGDYRLPDHPQPMEILNLYLGDSLEPHPGECPRETCSHEDPPEPFEEQTWATDPPEPTRQNVPPWGSGVELTHLGSWVHQDGLEPCQEQTRATDPPESTRQDAPPWGSGVELTHLGSPSAQREHRQNTASPGSPVNSHLPGSPKQNRSTSTQVVFWAGILQAQMCVLDLEEELEKTEGLKAGLKCCLPTPPVDLPGDTGLHSSPPENEDSGEDSSEPEGEGQAWLREGTPDSSPQWGAEEESMFFSNPLFLASPCSENSASGECFSWGASDSHAGVRTGPESPATLEPPLPEDTVLWELESEPDLGDGAAISGHCTPPFPVPIYKPHSICWASVAAAEGAPAAPPGHGESEGDRLGPAPSAAPCVDEALTWESGCVGSDLGPAAHPVQPWASLSPEGWQRGGPFWPQVTLNSQDRDEREGGHPQESLPCTLAPCPWRSPASSPEPSSPESESRGPGPRPSPASSQEGSPQLQHHSSGILPKWTLDASQSSLLETDGEQPSSLKKKEAGEAPKPGEEVKSEGTARPAETGDVQPDIHLTSAEHENLRTPMNSSWLPGSPMPQAQSPEEGQRPPAGDKLANGVRNNKVAWNLASRLYRLEGFRKSEVAAYLQKNNDFSRAVAEEYLSFFQFGGQSLDRALRSFLQALVLSGETQERERILYQFSRRFHHCNPGIFPSVDSVHTLTCAIMLLNTDLHGQNIGKSMSCQEFITNLNGLRDGGNFPKELLKALYWSIRSEKLEWAVDEEDTARPEKAQPSLPAGKMSKPFLQLAQDPTVPTYKQGILARKMHQDADGKKTPWGKRGWKMFHTLLRGMVLYFLKQGEDHCLEGESLVGQMVDEPVGVHHSLATPATHYTKKPHVFQLRTADWRLYLFQAPTAKEMSSWIARINLAAATHSAPPFPAAVGSQRRFVRPILPVGPAQSSLEEQHRSHENCLDAAADDLLDLQRNLPERRGRGRELEEHRLRKEYLEYEKTRYETYVQLLVARLHCPSDALDLWEEQLGREAGGTREPKLSLKKSHSSPSLHQDEAPTTAKVKRNISERRTYRKIIPKRNRNQL

SEQ ID NO: 58151 - protein, 383 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSMRQARRLSNPCIQRSIPPVLQNPNTLSVLPTQPPPPHIPQPLAATLWSQPLPWRSEDFTSLLPRSSQGTSRSRLSLQENQLPK

SEQ ID NO: 58152 - protein, 383 aa, Homo sapiens; identical to SEQ ID NO: 58151

SEQ ID NO: 58153 - protein, 404 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSEHPPGPSESKHAFRPTNAATATSHSTASRSNSLVSTFTMEKRGFYESLAKVKPGNFKVQTVSPREPASKVTEQALLRPQSKNGPQEKDCDLVDLDDASLPVSDV

SEQ ID NO: 58154 - protein, 114 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKIT

SEQ ID NO: 58155 - protein, 404 aa, Homo sapiens; identical to SEQ ID NO: 58153

SEQ ID NO: 58156 - protein, 404 aa, Homo sapiens; identical to SEQ ID NO: 58153

SEQ ID NO: 58157 - protein, 334 aa, Homo sapiens
MPYVDRQNRICGFLDIEENENSGKFLRRYFILDTREDSFVWYMDNPQNLPSGSSRVGAIKLTYISKVSDATKLRPKAEFCFVMNAGMRKYFLQANDQQDLVEWVNVLNKAIKITVPKQSDSQPNSDNLSRHGECGKKQVSYRTDIVGGVPIITPTQKEEVNECGESIDRNNLKRSQSHLPYFTPKPPQDSAVIKAGYCVKQGAVMKNWKRRYFQLDENTIGYFKSELEKEPLRVIPLKEVHKVQECKQSDIMMRDNLFEIVTTSRTFYVQADSPEEMHSWIKAVSGAIVAQRGPGRSASSMRQARRLSNPCIQRYTSRAGECSTYVGSHANVPS

SEQ ID NO: 58158 - protein, 425 aa, Homo sapiens
MPYVDRQNRICGFLDIEEHENSGKFLRRYFILDTQANCLLWYMDNPQNLAMGAGAVGALQLTYISKVSIATPKQKPKTPFCFVINALSQRYFLQANDQKDMKDWVEALNQASKITVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQDREPLRTIFLKDVLKTHECLVKSGDLLMRDNLFEIITSSRTFYVQADSPEDMHSWIKEIGAAVQALKCHPRETSFSRSISLTRPGSSSLSSGPNSILCRGRPPLEEKKALCKAPSVASSWQPWTPVPQAGEKLLPPGDTSEDSLFTPRPGEGSAPGVLPSSRIRHRSEPQHPKEKPFMFNLDDENIRTSDV

SEQ ID NO: 58159 - protein, 115 aa, Homo sapiens
MPYVDRQNRICGFLDIEEHENSGKFLRRYFILDTQANCLLWYMDNPQNLAMGAGAVGALQLTYISKVSIATPKQKPKTPFCFVINALSQRYFLQANDQKDMKDWVEALNQASKIT

SEQ ID NO: 58160 - protein, 375 aa, Homo sapiens
MGAGAVGALQLTYISKVSIATPKQKPKTPFCFVINALSQRYFLQANDQKDMKDWVEALNQASKITVPKGGGLPMTTEVLKSLAAPPALEKKPQVAYKTEIIGGVVVHTPISQNGGDGQEGSEPGSHTILRRSQSYIPTSGCRASTGPPLIKSGYCVKQGNVRKSWKRRFFALDDFTICYFKCEQDREPLRTIFLKDVLKTHECLVKSGDLLMRDNLFEIITSSRTFYVQADSPEDMHSWIKEIGAAVQALKCHPRETSFSRSISLTRPGSSSLSSGPNSILCRGRPPLEEKKALCKAPSVASSWQPWTPVPQAGEKLLPPGDTSEDSLFTPRPGEGSAPGVLPSSRIRHRSEPQHPKEKPFMFNLDDENIRTSDV

SEQ ID NO: 58161 - protein, 300 aa, Homo sapiens
MEGVLYKWTNYLTGWQPRWFVLDNGILSYYDSQDDVCKGSKGSIKMAVCEIKVHSADNTRMELIIPGEQHFYMKAVNAAERQRWLVALGSSKACLTDTRTKKEKEISETSESLKTKMSELRLYCDLLMQQVHTIQEFVHHDENHSSPSAENMNEASSLLSATCNTFITTLEECVKIANAKFKPEMFQLHHPDPLVSPVSPSPVQMMKRSVSHPGSCSSERSSHSIKEPVSTLHRLSQRRRRTYSDTDSCSDIPLEDPDRPVHCSKNTLNGDLASATIPEESRLMAKKQSESEDTLPSFSS

SEQ ID NO: 58162 - protein, 779 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQAHSGSPTYLQLPPRPPGTRASMVLLPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKAPVARPRMSAQEQLERMRRNQECGRPFPRPTSPRLLTLGRTLSPARRQPDVEQRPVVGHSGAQKWLRSSGSWSSPRNTTPYLPTSEGHRERVLSLSQALATEASQWHRMMTGGNLDSQGDPLPGVPLPPSDPTRQETPPPRSPPVANSGSTGFSRRGSGRGGGPTPWGPAWDAGIAPPVLPQDEGAWPLRVTLLQSSF

SEQ ID NO: 58163 - protein, 583 aa, Homo sapiens
MEGSRPRSSLSLASSASTISSLSSLSPKKPTRAVNKIHAFGKRGNALRRDPNLPVHIRGWLHKQDSSGLRLWKRRWFVLSGHCLFYYKDSREESVLGSVLLPSYNIRPDGPGAPRGRRFTFTAEHPGMRTYVLAADTLEDLRGWLRALGRASRAEGDDYGQPRSPARPQPGEGPGGPGGPPEVSRGEEGRISESPEVTRLSRGRGRPRLLTPSPTTDLHSGLQMRRARSPDLFTPLSRPPSPLSLPRPRSAPARRPPAPSGDTAPPARPHTPLSRIDVRPPLDWGPQRQTLSRPPTPRRGPPSEAGGGKPPRSPQHWSQEPRTQPGPPLESTFHQSLETDTLLTKLCGQDRLLRRLQEEIDQKQEEKEQLEAALELTRQQLGQATREAGAPGRAWGRQRLLQDRLVSVRATLCHLTQERERVWDTYSGLEQELGTLRETLEYLLHLGSPQDRVSAQQQLWMVEDTLAGLGGPQKPPPHTEPDSPSPVLQGEESSERESLPESLELSSPRSPETDWGRPPGGDKDLASPHLGLGSPRVSRASSPEGRHLPSPQLGTKSKEHHPLLADFRRSPGAGSQPLPSPGY

SEQ ID NO: 58164 - protein, 1121 aa, Homo sapiens
MAAATVGRDTLPEHWSYGVCRDGRVFFINDQLRCTTWLHPRTGEPVNSGHMIRSDLPRGWEEGFTEEGASYFIDHNQQTTAFRHPVTGQFSPENSEFILQEEPNPHMSKQDRNQRPSSMVSETSTAGTASTLEAKPGPKIIKSSSKVHSFGKRDQAIRRNPNVPVVVRGWLHKQDSSGMRLWKRRWFVLADYCLFYYKDSREEAVLGSIPLPSYVISPVAPEDRISRKYSFKAVHTGMRALIYNSSTAGSQAEQSGMRTYYFSADTQEDMNAWVRAMNQAAQVLSRSSLKRDMEKVERQAVPQANHTESCHECGRVGPGHTRDCPHRGHDDIVNFERQEQEGEQYRSQRDPLEGKRDRSKARSPYSPAEEDALFMDLPTGPRGQQAQPQRAEKNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 58165 - protein, 1122 aa, Homo sapiens
MAAATVGRDTLPEHWSYGVCRDGRVFFINDQLRCTTWLHPRTGEPVNSGHMIRSDLPRGWEEGFTEEGASYFIDHNQQTTAFRHPVTGQFSPENSEFILQEEPNPHMSKQDRNQRPSSMVSETSTAGTASTLEAKPGPKIIKSSSKVHSFGKRDQAIRRNPNVPVVVRGWLHKQDSSGMRLWKRRWFVLADYCLFYYKDSREEAVLGSIPLPSYVISPVAPEDRISRKYSFKAVHTGMRALIYNSSTAGSQAEQSGMRTYYFSADTQEDMNAWVRAMNQAAQVLSRSSLKRDMEKVERQAVPQANHTESCHECGRVGPGHTRDCPHRGHDDIVNFERQEQEGEQYRSQRDPLEGKRDRSKARSPYSPAEEDALFMDLPTGPRGQQAQPQRAEKNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVQEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 58166 - protein, 753 aa, Homo sapiens
  MOD_RES (1)..(1): Any amino acid
XDALFMDLPTGPRGQQAQPQRAEKNGMLPASYGPGEQNGTGGYQRAFPPRTNPEKHSQRKSNLAQVEHWARAQKGDSRSLPLDQTLPRQGPGQSLSFPENYQTLPKSTRHPSGGSSPPPRNLPSDYKYAQDRASHLKMSSEERRAHRDGTVWQLYEWQQRQQFRHGSPTAPICLGSPEFTDQGRSRSMLEVPRSISVPPSPSDIPPPGPPRVFPPRRPHTPAERVTVKPPDQRRSVDISLGDSPRRARGHAVKNSSHVDRRSMPSMGYMTHTVSAPSLHGKSADDTYLQLKKDLEYLDLKMTGRDLLKDRSLKPVKIAESDTDVKLSIFCEQDRVLQDLEDKIRALKENKDQLESVLEVLHRQMEQYRDQPQHLEKIAYQQKLLQEDLVHIRAELSRESTEMENAWNEYLKLENDVEQLKQTLQEQHRRAFFFQEKSQIQKDLWRIEDVTAGLSANKENFRILVESVKNPERKTVPLFPHPPVPSLSTSESKPPPQPSPPTSPVRTPLEVRLFPQLQTYVPYRPHPPQLRKVTSPLQSPTKAKPKVQEDEAPPRPPLPELYSPEDQPPAVPPLPREATIIRHTSVRGLKRQSDERKRDRELGQCVNGDSRVELRSYVSEPELATLSGDMAQPSLGLVGPESRYQTLPGRGLSGSTSRLQQSSTIAPYVTLRRGLNAESSKATFPRPKSALERLYSGDHQRGKMSAEEQLERMKRHQKALVRERKRTLGQGERTGLPSSRYLSRPLPGDLGSVC

SEQ ID NO: 58167 - protein, 189 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 58168 - protein, 243 aa, Homo sapiens
MSPAAPVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVVPPNAHEATYVRSYYGPPYAGPGVTHVIVREDPCYSAGAPLAMGMLAGAATGAALGSLMWSPCWF

SEQ ID NO: 58169 - protein, 208 aa, Homo sapiens
MSPAAPVPPDSALESPFEEMALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGAPLAMGMLAGAATGAALGSLMWSPCWF

SEQ ID NO: 58170 - protein, 224 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVVPPNAHEATYVRSYYGPPYAGPGVTHVIVREDPCYSAGAPLAMGMLAGAATGAALGSLMWSPCWF

SEQ ID NO: 58171 - protein, 189 aa, Homo sapiens; identical to SEQ ID NO: 58167

SEQ ID NO: 58172 - protein, 117 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSP

SEQ ID NO: 58173 - protein, 163 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVREDPCYSAGA

SEQ ID NO: 58174 - protein, 159 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPMIRLKLIHPHNKYLLSCYSAGAPLAMGMLAGAATGAALGSLMWSPCWF

SEQ ID NO: 58175 - protein, 160 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPAPAGATVPPRSRRVCSKVRCVTRSWSPCKVERRIWVRVYSPYQDYYEVV

SEQ ID NO: 58176 - protein, 154 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGGRLHLCAETKDDALAWKTALLEANSTPVRVYSPYQDYYEVVPPNAHEATYVRSYYGPPYAGPGVTHVIVR

SEQ ID NO: 58177 - protein, 85 aa, Homo sapiens
MALVRGGWLWRQSSILRRWKRNWFALWLDGTLGYYHDETAQDEEDRVLIHFNVRDIKIGPECHDVQPPEGRSRDGLLTVNLREGG

SEQ ID NO: 58178 - protein, 1191 aa, Homo sapiens
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGESDTPGVGLVGDPGPSRAMPSGLSPGALDSDPVGLGDPLSEISKLLEAAPSGSGLPKPADCLLAQDLCWELLASGMATLPGTRDVQGRAVLLLCAHSPAWLQSECSSQELIRLLLYLRSIPRPEVQALGLTVLVDARICAPSSSLFSGLSQLQEAAPGAVYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLTAEDSEISSQCPSASGSSGSDSSCVSGQALGRGLEDLPCV

SEQ ID NO: 58179 - protein, 1191 aa, Homo sapiens; identical to SEQ ID NO: 58178

SEQ ID NO: 58180 - protein, 193 aa, Homo sapiens
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGESDTPGVGLVGDPGPSRAMPSGLSPGALDSDPVGLGDPLSEISKLLEAGKEGWAREVWEGNGDAWRDECQDFGGL

SEQ ID NO: 58181 - protein, 1191 aa, Homo sapiens; identical to SEQ ID NO: 58178

SEQ ID NO: 58182 - protein, 1110 aa, Homo sapiens
MERPLENGDESPDSQGHATDWRFAVCSFRDAWEEEEPASQMHVKDPGPPRPPAGATQDEELQGSPLSRKFQLPPAADESGDAQRGTVESSSVLSEGPGPSGVESLLCPMSSHLSLAQGTRDVQGRAVLLLCAHSPAWLQSECSSQELIRLLLYLRSIPRPEVQALGLTVLVDARICAPSSSLFSGLSQLQEAAPGAVYQVLLVGSTLLKEVPSGLQLEQLPSQSLLTHIPTAGLPTSLGGGLPYCHQAWLDFRRRLEALLQNCQAACALLQGAIESVKAVPQPMEPGEVGQLLQQTEVLMQQVLDSPWLAWLQCQGGRELTWLKQEVPEVTLSPDYRTAMDKADELYDRVDGLLHQLTLQSNQRIQALELVQTLEARESGLHQIEVWLQQVGWPALEEAGEPSLDMLLQAQGSFQELYQVAQEQVRQGEKFLQPLTGWEAAELDPPGARFLALRAQLTEFSRALAQRCQRLADAERLFQLFREALTWAEEGQRVLAELEQERPGVVLQQLQLHWTRHPDLPPAHFRKMWALATGLGSEAIRQECRWAWARCQDTWLALDQKLEASLKLPPVGSTASLCVSQVPAAPAHPPLRKAYSFDRNLGQSLSEPACHCHHAATIAACRRPEAGGGALPQASPTVPPPGSSDPRSLNRLQLVLAEMVATEREYVRALEYTMENYFPELDRPDVPQGLRGQRAHLFGNLEKLRDFHCHFFLRELEACTRHPPRVAYAFLRHRVQFGMYALYSKNKPRSDALMSSYGHTFFKDKQQALGDHLDLASYLLKPIQRMGKYALLLQELARACGGPTQELSALREAQSLVHFQLRHGNDLLAMDAIQGCDVNLKEQGQLVRQDEFVVRTGRHKSVRRIFLFEELLLFSKPRHGPTGVDTFAYKRSFKMADLGLTECCGNSNLRFEIWFRRRKARDTFVLQASSLAIKQAWTADISHLLWRQAVHNKEVRMAEMVSMGVGNKAFRDIAPSEEAINDRTVNYVLKCREVRSRASIAVAPFDHDSLYLGASNSLPGDPASCSVLGSLNLHLYRDPALLGLRCPLYPSFPEEAALEAEAELGGQPSLTAEDSEISSQCPSASGSSGSDSSCVSGQALGRGLEDLPCV

SEQ ID NO: 58183 - protein, 1006 aa, Homo sapiens
MHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 58184 - protein, 930 aa, Homo sapiens
MHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPAQEADPGPALPNQDHPAA

SEQ ID NO: 58185 - protein, 1006 aa, Homo sapiens; identical to SEQ ID NO: 58183

SEQ ID NO: 58186 - protein, 1043 aa, Homo sapiens
MDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 58187 - protein, 1006 aa, Homo sapiens; identical to SEQ ID NO: 58183

SEQ ID NO: 58188 - protein, 852 aa, Homo sapiens
MNSVLTKHGSPPRSWLSLCSGTDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHWKLTLAQLYRIRTTLLLNSTLTASEV

SEQ ID NO: 58189 - protein, 1083 aa, Homo sapiens
MNSVLTKHGSPPRSWLSLCSGTDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 58190 - protein, 1006 aa, Homo sapiens; identical to SEQ ID NO: 58183

SEQ ID NO: 58191 - protein, 1062 aa, Homo sapiens
MDDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 58192 - protein, 1075 aa, Homo sapiens
MGTGPGVSGRLAASRPGPGLPLRDSEPSWAGGRARDGDSQVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 58193 - protein, 912 aa, Homo sapiens
MKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 58194 - protein, 1085 aa, Homo sapiens
MSLGERGSPQTFGGSSVSKGSDAGHDQSPAEKKGLRCQNPACMDKGRAAKVCHHADCQQLHRRGPLNLCEACDSKFHSTMHYDGHVRFDLPPQGSVLARNVSTRSCPPRTSPAVDLEEEEEESSVDGKGDRKSTGLKLSKKKARRRHTDDPSKECFTLKFDLNVDIETEIVPAMKKKSLGEVLLPVFERKGIALGKVDIYLDQSNTPLSLTFEAYRFGGHYLRVKAPAKPGDEGKVEQGMKDSKSLSLPILRPAGTGPPALERVDAQSRRESLDILAPGRRRKNMSEFLGEASIPGQEPPTPSSCSLPSGSSGSTNTGDSWKNRAASRFSGFFSSGPSTSAFGREVDKMEQLEGKLHTYSLFGLPRLPRGLRFDHDSWEEEYDEDEDEDNACLRLEDSWRELIDGHEKLTRRQCHQQEAVWELLHTEASYIRKLRVIINLFLCCLLNLQESGLLCEVEAERLFSNIPEIAQLHRRLWASVMAPVLEKARRTRALLQPGDFLKGFKMFGSLFKPYIRYCMEEEGCMEYMRGLLRDNDLFRAYITWAEKHPQCQRLKLSDMLAKPHQRLTKYPLLLKSVLRKTEEPRAKEAVVAMIGSVERFIHHVNACMRQRQERQRLAAVVSRIDAYEVVESSSDEVDKLLKEFLHLDLTAPIPGASPEETRQLLLEGSLRMKEGKDSKMDVYCFLFTDLLLVTKAVKKAERTRVIRPPLLVDKIVCRELRDPGSFLLIYLNEFHSAVGAYTFQASGQALCRGWVDTIYNAQNQLQQLRAQEPPGSQQPLQSLEEEEDEQEEEEEEEEEEEEGEDSGTSAASSPTIMRKSSGSPDSQHCASDGSTETLAMVVVEPGDTLSSPEFDSGPFSSQSDETSLSTTASSATPTSELLPLGPVDGRSCSMDSAYGTLSPTSLQDFVAPGPMAELVPRAPESPRVPSPPPSPRLRRRTPVQLLSCPPHLLKSKSEASLLQLLAGAGTHGTPSAPSRSLSELCLAVPAPGIRTQGSPQEAGPSWDCRGAPSPGSGPGLVGCLAGEPAGSHRKRCGDLPSGASPRVQPEPPPGVSAQHRKLTLAQLYRIRTTLLLNSTLTASEV

SEQ ID NO: 58195 - protein, 930 aa, Homo sapiens; identical to SEQ ID NO: 58184

SEQ ID NO: 58196 - protein, 790 aa, Homo sapiens
MKAFGPPHEGPLQGLVASRIETYGGRHRASAQSTAGRLYPRGYPVLDPSRRRLQQYVPFARGSGQARGLSPMRLRDPEPEKRHGGHVGAGLLHSPKLKELTKAHELEVRLHTFSMFGMPRLPPEDRRHWEIGEGGDSGLTIEKSWRELVPGHKEMSQELCHQQEALWELLTTELIYVRKLKIMTDLLAAGLLNLQRVGLLMEVSAETLFGNVPSLIRTHRSFWDEVLGPTLEETRASGQPLDPIGLQSGFLTFGQRFHPYVQYCLRVKQTMAYAREQQETNPLFHAFVQWCEKHKRSGRQMLCDLLIKPHQRITKYPLLLHAVLKRSPEARAQEALNAMIEAVESFLRHINGQVRQGEEQESLAAAAQRIGPYEVLEPPSDEVEKNLRPFSTLDLTSPMLGVASEHTRQLLLEGPVRVKEGREGKLDVYLFLFSDVLLVTKPQRKADKAKVIRPPLMLEKLVCQPLRDPNSFLLIHLTEFQCVSSALLVHCPSPTDRAQWLEKTQQAQAALQKLKAEEYVQQKRELLTLYRDQDRESPSTRPSTPSLEGSQSSAEGRTPEFSTIIPHLVVTEDTDEDAPLVPDDTSDSGYGTLIPGTPTGSRSPLSRLRQRALRRDPRLTFSTLELRDIPLRPHPPDPQAPQRRSAPELPEGILKGGSLPQEDPPTWSEEEDGASERGNVVVETLHRARLRGQLPSSPTHADSAGESPWESSGEEEEEGPLFLKAGHTSLRPMRAEDMLREIREELASQRIEGAEEPRDSRPRKLTRAQLQRMRGPHIIQLDTPLSASEV

SEQ ID NO: 58197 - protein, 320 aa, Homo sapiens
MCPREGGRASTIHQKTEKAFGQLLCQPLGEPKIQHPLKAALQKLKAEEYVQQKRELLTLYRDQDRESPSTRPSTPSLEGSQSSAEGRTPEFSTIIPHLVVTEDTDEDAPLVPDDTSDSGYGTLIPGTPTGSRSPLSRLRQRALRRDPRLTFSTLELRDIPLRPHPPDPQAPQRRSAPELPEGILKGGSLPQEDPPTWSEEEDGASERGNVVVETLHRARLRGQLPSSPTHADSAGESPWESSGEEEEEGPLFLKAGHTSLRPMRAEDMLREIREELASQRIEGAEEPRDSRPRKLTRAQLQRMRGPHIIQLDTPLSASEV

SEQ ID NO: 58198 - protein, 790 aa, Homo sapiens; identical to SEQ ID NO: 58196

SEQ ID NO: 58199 - protein, 758 aa, Homo sapiens
MGCRLHAPGEKAAHDPSRRRLQQYVPFARGSGQARGLSPMRLRDPEPEKRHGGHVGAGLLHSPKLKELTKAHELEVRLHTFSMFGMPRLPPEDRRHWEIGEGGDSGLTIEKSWRELVPGHKEMSQELCHQQEALWELLTTELIYVRKLKIMTDLLAAGLLNLQRVGLLMEVSAETLFGNVPSLIRTHRSFWDEVLGPTLEETRASGQPLDPIGLQSGFLTFGQRFHPYVQYCLRVKQTMAYAREQQETNPLFHAFVQWCEKHKRSGRQMLCDLLIKPHQRITKYPLLLHAVLKRSPEARAQEALNAMIEAVESFLRHINGQVRQGEEQESLAAAAQRIGPYEVLEPPSDEVEKNLRPFSTLDLTSPMLGVASEHTRQLLLEGPVRVKEGREGKLDVYLFLFSDVLLVTKPQRKADKAKVIRPPLMLEKLVCQPLRDPNSFLLIHLTEFQCVSSALLVHCPSPTDRAQWLEKTQQAQAALQKLKAEEYVQQKRELLTLYRDQDRESPSTRPSTPSLEGSQSSAEGRTPEFSTIIPHLVVTEDTDEDAPLVPDDTSDSGYGTLIPGTPTGSRSPLSRLRQRALRRDPRLTFSTLELRDIPLRPHPPDPQAPQRRSAPELPEGILKGGSLPQEDPPTWSEEEDGASERGNVVVETLHRARLRGQLPSSPTHADSAGESPWESSGEEEEEGPLFLKAGHTSLRPMRAEDMLREIREELASQRIEGAEEPRDSRPRKLTRAQLQRMRGPHIIQLDTPLSASEV

SEQ ID NO: 58200 - protein, 1493 aa, Homo sapiens
MAELSEPEGPVDWKERCVALESQLMKFRVQASKIRELLAEKMQQLERQVIDAERQAEKAFQQVQVMEDKLKAANIQTSESETRLYNKCQDLESLIQEKDDVIQNLELQLEEQKQIRIQEAKIIEEKAAKIKEWVTVKLNELELENQNLRLINQNQTEEIRTMQSKLQEVQGKKSSTVSTLKLSEGQRLSSLTFGCFLSRARSPPQVVKSEEMSKISSKEPEFTEGKDMEEMEIPEKSVDNQVLENNRGQRTLHQTPCGSEQNRKTRTSFATDGGISQNSGAPVSDWSSDEEDGSKGRSKSRCTSTLSSHTSEEGVQCSRMGSEMYLTASDDSSSIFEEETFGIKRPEHKKLYSWQQEAQWKALNSPLGKGNSELSKKEQDSSSDELNKKFQSQRLDYSSSSSEANTPSPILTPALMPKHPNSLSGKGTQLVPSSHLPPPKLRIPNVFSISVALAKRHLSQPQLSSDRMFGTNRNAISMIRPLRPQETDLDLVDGDSTEVLENMDTSCDDGLFSYDSLDSPNSDDQEHCDSAKKVAYSKPPTPPLHRFPSWESRIYAVAKSGIRMSEAFNMESVNKNSAATLSYTTSGLYTSLIYKNMTTPVYTTLKGKATQISSSPFLDDSSGSEEEDSSRSSSRTSESDSRSRSGPGSPRAMKRGVSLSSVASESDYAIPPDAYSTDTEYSQPEQKLPKTCSSSSDNGKNEPLEKSGYLLKMSGKVKSWKRRWFVLKGGELLYYKSPSDVIRKPQGHIELSASCSILRGDNKQTVQLTTEKHTYYLTADSPNILEEWIKVLQNVLRVQAANPLSLQPEGKPTMKGLLTKVKHGYSKRVWCTLIGKTLYYFRSQEDKFPLGQIKLWEAKVEEVDRSCDSDEDYEASGRSLLSTHYTIVIHPKDQGPTYLLIGSKHEKDTWLYHLTVAAGSNNVNVGSEFEQLVCKLLNIDGEPSSQIWRHPTLCHSKEGIISPLTTLPSEALQTEAIKLFKTCQLFINAAVDSPAIDYHISLAQSALQICLTHPELQNEICCQLIKQTRRRQPQNQPGPLQGWQLLALCVGLFLPHHPFLWLLRLHLKRNADSRTEFGKYAIYCQRCVERTQQNGDREARPSRMEILSTLLRNPYHHSLPFSIPVHFMNGIYQVVGFDASTTVEEFLNTLNQDTGMRKPAQSGFALFTDDPSGRDLEHCLQGNIKICDIISKWEQASKEQQPGKCEGTRTVRLTYKNRLYFSVQARGETDREKLLLMYQTNDQIINGLFPLNKDLALEMAALLSQVEIGDFERPFSTPAGHVTNQCKVNQTLKQVIEKFYPKRYRDGCSEEQLRQLCQRLSTRWMALRGHSAADCVRIYLTVARKWPFFGAKLFLAKPITPSSLGSTFLWLAVHEDGLSLLEYNSMRLIVSYVYKSLMTFGGYQDDFMVVINNTHSKDKPTEKLLFAMAKPKILEITLLIASYINNFHQQKAAFHHLSAPALLSAQTRGPQARMMGSQPLLSSSRPTKGPTLL

SEQ ID NO: 58201 - protein, 967 aa, Homo sapiens
MDWTPRLPSRHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 58202 - protein, 1056 aa, Homo sapiens
MLSVVENGLDPQAAIPVIKKKLVGSVKALQKQYVSLDTVVTSEDGDANTMCSALEAVFIHGLHAKHIRAEAGGKRKKSAHQKPLPQPVFWPLLKAVTHKHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFLKALIEFASQHVYHCDLCTQRGFICQICQHHDIIFPFEFDTTVRCAECKTVFHQSCQAVVKKGCPRCARRRKYQEQNIFA

SEQ ID NO: 58203 - protein, 1000 aa, Homo sapiens
MVECFESGGTRLSLSSFNVSCDSLREQLREWRCFQWWRMDWTPRLPSRHIISELEHLTFVNTDVGRCRAWLRLALNDGLMECYLKLLLQEQARLHEYYQPTALLRDAEEGEFLLSFLQGLTSLSFELSYKSAILNEWTLTPLALSGLCPLSELDPLSTSGAELQRKESLDSISHSSGSEDIEVHHSGHKIRRNQKLTASSLSLDTASSSQLSCSLNSDSCLLQENGSKSPDHCEEPMSCDSDLGTANAEDSDRSLQEVLLEFSKAQVNSVPTNGLSQETEIPTPQASLSLHGLNTSTYLHCEAPAEPLPAQAASGTQDGVHVQEPRPQAPSPLDLQQPVESTSGQQPSSTVSETAREVGQGNGLQKAQAHDGAGLKLVVSSPTSPKNKSWISEDDFYRPSREQPLESASDHPIASYRGTPGSRPGLHRHFSQEPRKNCSLGALDQACVPSPGRRQAQAAPSQGHKSFRVVHRRQMGLSNPFRGLMKLGTVERRGAMGIWKELFCELSPLEFRLYLSNEEHTCVENCSLLRCESVGPAHSDGRFELVFSGKKLALRASSQDEAEDWLDRVREALQKVRPQQEDEWVNVQYPDQPEEPPEAPQGCLSPSDLLSEPAALQGTQFDWSSAQVPEPDAIKESLLYLYMDRTWMPYIFSLSLEALKCFRIRNNEKMLSDSHGVETIRDILPDTSLGGPSFFKIITAKAVLKLQAGNAEEAALWRDLVRKVLASYLETAEEAVTLGGSLDENCQEVLKFATRENGFLLQYLVAIPMEKGLDSQGCFCAGCSRQIGFSFVRPKLCAFSGLYYCDICHQDDASVIPARIIHNWDLTKRPICRQALKFLTQIRAQPLINLQMVNASLYEHVERMHLIGRRREQLKLLGDYLGLCRSGALKELSKRLNHRNYLLESPHRFSVADLQQIADGVYEGFSPKVPSEAAGLRPWGARSPEAASAFRCIDSSRLPSLRKVVPTLFLKCYFMQYTVPSEQGSGPEESLQCIEGIAAV

SEQ ID NO: 58204 - protein, 1821 aa, Homo sapiens
MSCERKGLSELRSELYFLIARFLEDGPCQQAAQVLIREVAEKELLPRRTDWTGKEHPRTYQNLVKYYRHLAPDHLLQICHRLGPLLEQEIPQSVPGVQTLLGAGRQSLLRTNKSCKHVVWKGSALAALHCGRPPESPVNYGSPPSIADTLFSRKLNGKYRLERLVPTAVYQHMKMHKRILGHLSSVYCVTFDRTGRRIFTGSDDCLVKIWATDDGRLLATLRGHAAEISDMAVNYENTMIAAGSCDKMIRVWCLRTCAPLAVLQGHSASITSLQFSPLCSGSKRYLSSTGADGTICFWLWDAGTLKINPRPAKFTERPRPGVQMICSSFSAGGMFLATGSTDHIIRVYFFGSGQPEKISELEFHTDKVDSIQFSNTSNRFVSGSRDGTARIWQFKRREWKSILLDMATRPAGQNLQGIEDKITKMKVTMVAWDRHDNTVITAVNNMTLKVWNSYTGQLIHVLMGHEDEVFVLEPHPFDPRVLFSAGHDGNVIVWDLARGVKIRSYFNMIEGQGHGAVFDCKCSPDGQHFACTDSHGHLLIFGFGSSSKYDKIADQMFFHSDYRPLIRDANNFVLDEQTQQAPHLMPPPFLVDVDGNPHPSRYQRLVPGRENCREEQLIPQMGVTSSGLNQVLSQQANQEISPLDSMIQRLQQEQDLRRSGEAVISNTSRLSRGSISSTSEVHSPPNVGLRRSGQIEGVRQMHSNAPRSEIATERDLVAWSRRVVVPELSAGVASRQEEWRTAKGEEEIKTYRSEEKRKHLTVPKENKIPTVSKNHAHEHFLDLGESKKQQTNQHNYRTRSALEETPRPSEEIENGSSSSDEGEVVAVSGGTSEEEERAWHSDGSSSDYSSDYSDWTADAGINLQPPKKVPKNKTKKAESSSDEEEESEKQKQKQIKKEKKKVNEEKDGPISPKKKKPKERKQKRLAVGELTENGLTLEEWLPSTWITDTIPRRCPFVPQMGDEVYYFRQGHEAYVEMARKNKIYSINPKKQPWHKMELREQELMKIVGIKYEVGLPTLCCLKLAFLDPDTGKLTGGSFTMKYHDMPDVIDFLVLRQQFDDAKYRRWNIGDRFRSVIDDAWWFGTIESQEPLQLEYPDSLFQCYNVCWDNGDTEKMSPWDMELIPNNAVFPEELGTSVPLTDGECRSLIYKPLDGEWGTNPRDEECERIVAGINQLMTLDIASAFVAPVDLQAYPMYCTVVAYPTDLSTIKQRLENRFYRRVSSLMWEVRYIEHNTRTFNEPGSPIVKSAKFVTDLLLHFIKDQTCYNIIPLYNSMKKKVLSDSEDEEKDADVPGTSTRKRKDHQPRRRLRNRAQSYDIQAWKKQCEELLNLIFQCEDSEPFRQPVDLLEYPDYRDIIDTPMDFATVRETLEAGNYESPMELCKDVRLIFSNSKAYTPSKRSRIYSMSLRLSAFFEEHISSVLSDYKSALRFHKRNTITKRRKKRNRSSSVSSSAASSPERKKRILKPQLKSESSTSAFSTPTRSIPPRHNAAQINGKTESSSVVRTRSNRVVVDPVVTEQPSTSSAAKTFITKANASAIPGKTILENSVKHSKALNTLSSPGQSSFSHGTRNNSAKENMEKEKPVKRKMKSSVLPKASTLSKSSAVIEQGDCKNNALVPGTIQVNGHGGQPSKLVKRGPGRKPKVEVNTNSGEIIHKKRGRKPKKLQYAKPEDLEQNNVHPIRDEVLPSSTCNFLSETNNVKEDLLQKKNRGGRKPKRKMKTQKLDADLLVPASVKVLRRSNRKKIDDPIDEEEEFEELKGSEPHMRTRNQGRRTAFYNEDDSEEEQRQLLFEDTSLTFGTSSRGRVRKLTEKAKANLIGW

SEQ ID NO: 58205 - protein, 398 aa, Homo sapiens
MKKKVLSDSEDEEKDADVPGTSTRKRKDHQPRRRLRNRAQSYDIQAWKKQCEELLNLIFQCEDSEPFRQPVDLLEYPDYRDIIDTPMDFATVRETLEAGNYESPMELCKDVRLIFSNSKAYTPSKRSRIYSMSLRLSAFFEEHISSVLSDYKSALRFHKRNTITKRRKKRNRSSSVSSSAASSPERKKRILKPQLKSESSTSAFSTPTRSIPPRHNAAQINGKTESSSVVRTRSNRVVVDPVVTEQPSTSSAAKTFITKANASAIPGKTILENSVKHSKALNTLSSPGQSSFSHGTRNNSAKENMEKEKPVKRKMKSSVLPKASTLSKSSAVIEQGDCKNNALVPGTIQVNGHGGQPSKLVKRGPGRKPKVEVNIVVKLYTRKGVESPKSYSMQSQKI

SEQ ID NO: 58206 - protein, 401 aa, Homo sapiens
MRRAPAAERLLELGFPPRCGRQEPPFPLGVTRGWGRWPIQKRREGARPVPFSERSQEDGRGPAARSSGTLWRIRTRLSLCRDPEPPPPLCLLRVSLLCALRAGGRGSRWGEDGARLLLLPPARAAGNGEAEPSGGPSYAGRMLESSGCKALKEGVLEKRSDGLLQLWKKKCCILTEEGLLLIPPKQLQHQQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQPPSQPQPQPQLQPQPQPQPQPQPQPQSQPQPQPQPKPQPQQLHPYPHPHPHPHSHPHSHPHPHPHPHPHQIPHPHPQPHSQPHGHRLLRSTSNSA

SEQ ID NO: 58207 - protein, 219 aa, Homo sapiens
MLESSGCKALKEGVLEKRSDGLLQLWKKKCCILTEEGLLLIPPKQLQHQQQQQQQQQQQQQQQPGQGPAEPSQPSGPAVASLEPPVKLKELHFSNMKTVDCVERKGKYMYFTVVMAEGKEIDFRCPQDQGWNAEITLQMVQYKNRQAILAVKSTRQKQQHLVQQQLHPYPHPHPHPHSHPHSHPHPHPHPHPHQIPHPHPQPHSQPHGHRLLRSTSNSA

SEQ ID NO: 58208 - protein, 152 aa, Homo sapiens
MKSPDEVLREGELEKRSDSLFQLWKKKRGVLTSDRLSLFPASPRARPKELRFHSILKVDCVERTGKYVYFTIVTTDHKEIDFRCAGESCWNAAIALALIDFQNRRALQDFRSRQERTAPAAPAEDAVAAAAAAPSEPSEPSRPSPQPKPRTP

SEQ ID NO: 58209 - protein, 1319 aa, Homo sapiens
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 58210 - protein, 730 aa, Homo sapiens
MERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKERAELAAGRRHLARQALYAELQTQLDNCPESVREQLQEQLRREAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEMEKLLLPAVDLEQWYQELMAGLGTGPAAASPHSSPPPLPAKASRQLQVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 58211 - protein, 1377 aa, Homo sapiens
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEMEKLLLPAVDLEQWYQELMAGLGTGPAAASPHSSPPPLPAKASRQLQVYRSKMDGEATSPLPRTRSGPLPSSSGSSSSSSQLSVATLGRSPSPKSALLTQNGTGSLPRNLAATLQDIETKRQLALQQKGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKKRFFRFTMVTESPNPALTFCVKTHDRLYYMVAPSAEAMRIWMDVIVTGAEGYTQFMN

SEQ ID NO: 58212 - protein, 1140 aa, Homo sapiens
MSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPASGALSQPTSIPGSPKFQPPVPAPRNKIGTLQDRPPSPFREPPGSERVLTTSPSRQLVGRTFSDGLATRTLQPPESPRLGRRGLDSMRELPPLSPSLSRRALSPLPTRTTPDPKLNREVAESPRPRRWAAHGASPEDFSLTLGARGRRTRSPSPTLGESLAPHKGSFSGRLSPAYSLGSLTGASPCQSPCVQRKLSSGDLRVPVTRERKNSITEISDNEDDLLEYHRRQRQERLREQEMERLERQRLETILNLCAEYSRADGGPEAGELPSIGEATAALALAGRRPSRGLAGASGRSSEEPGVATQRLWESMERSDEENLKEECSSTESTQQEHEDAPSTKLQGEVLALEEERAQVLGHVEQLKVRVKELEQQLQESAREAEMERALLQGEREAERALLQKEQKAVDQLQEKLVALETGIQKERDKEAEALETETKLFEDLEFQQLERESRVEEERELAGQGLLRSKAELLRSIAKRKERLAILDSQAGQIRAQAVQESERLARDKNASLQLLQKEKEKLTVLERRYHSLTGGRPFPKTTSTLKEMEKLLLPAVDLEQWYQELMAGLGTGPAAASPHSSPPPLPAKASRQLQVYRSKMDGEATSPLPRTRSGPLPSSSGSSSSSSQLSVATLGRSPSPKSALLTQNGTGSLPRNLAATLQDIETKRQLALQQKVESLPAEPLPTDDPAGQQVIEEQRRRLAELKQKAAAEAQCQWDALHGAAPFPAGPSGFPPLMHHSILHHLPAGRERGEEGEHAYDTLSLESSDSMETSISTGGNSACSPDNMSSASGLDMGKIEEMEKMLKEAHAEKNRLMESREREMELRRQALEEERRRREQVERRLQSESARRQQLVEKEVKMREKQFSQARPLTRYLPIRKEDFDLKTHIESSGHGVDTCLHVVLSSKVCRGYLVKMGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 58213 - protein, 101 aa, Homo sapiens
MGGKIKSWKKRWFVFDRLKRTLSYYVDKHETKLKGVIYFQAIEEVYYDHLRSAAKSPNPALTFCVKTHDRLYYMVAPSAEAMRIWMDVIVTGAEGYTQFMN

SEQ ID NO: 58214 - protein, 372 aa, Homo sapiens
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPESESLVNGNHTPQTATRGPSACASHSSLVSSIEKDLQEIMDSLVLEEPGAAGKKPAATSPLSPMANGGRYLLSPPTSPGAMSVGSSYENTSPAFSPLSSPASSGSCASHSPSGQEPGPSVPPLVPARSSSYHLALQPPQSRPSGARSESPRLSRKGGHERPPSPGLRGLLTDSPAATVLAEARRATESPRLGGQLPVVAISLSEYPAARRCT

SEQ ID NO: 58215 - protein, 247 aa, Homo sapiens
MDALNRNQIGPGCQTQTMVQKGPLDLIETGKGLKVQTDKPHLVSLGSGRLSTAITLLPLEEGRTVIGSAARDISLQGPGLAPEHCYIENLRGTLTLYPCGNACTIDGLPVRQPTRLTQGCMLCLGQSTFLRFNHPAEAKWMKSMIPAGGRAPGPPYSPVPAESESLVNGNHTPQTATRGPSACASHSSLVSSIEKDLQEIMDSLVLEEPGAAGKKPAATSPLSPMANGGRYLLSPPTSPGHVCGLQL

SEQ ID NO: 58216 - protein, 4684 aa, Homo sapiens
MVAGMLMPRDQLRAIYEVLFREGVMVAKKDRRPRSLHPHVPGVTNLQVMRAMASLRARGLVRETFAWCHFYWYLTNEGIAHLRQYLHLPPEIVPASLQRVRRPVAMVMPARRTPHVQAVQGPLGSPPKRGPLPTEEQRVYRRKELEEVSPETPVVPATTQRTLARPGPEPAPATDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58217 - protein, 4547 aa, Homo sapiens
MSQHQLRVPQPEGLGRKRTSSEDNLYLAVLRASEGKKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58218 - protein, 4547 aa, Homo sapiens
MEPSGSLFPSLVVVGHVVTLAAVWHWRRGRRWAQDEQDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58219 - protein, 4525 aa, Homo sapiens
MDPSRAIQNEISSLKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58220 - protein, 4533 aa, Homo sapiens
MAGPLPDEQDFIQAYEEVREKYKDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58221 - protein, 4551 aa, Homo sapiens
MSGAGGAFASPREVLLERPCWLDGGCEPARRGYLYQQLCCVDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58222 - protein, 4515 aa, Homo sapiens
MKIVPDERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58223 - protein, 4574 aa, Homo sapiens
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGVRANELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58224 - protein, 4570 aa, Homo sapiens
MSGEDAEVRAVSEDVSNGSSGSPSPGDTLPWNLGKTQRSRRSGGGAGSNGSVLDPAERAVIRIADERDRVQKKTFTKWVNKHLIKAQRHISDLYEDLRDGHNLISLLEVLSGDSLPREKGRMRFHKLQNVQIALDYLRHRQVKLVNIRNDDIADGNPKLTLGLIWTIILHFQISDIQVSGQSEDMTAKEKLLLWSQRMVEGYQGLRCDNFTSSWRDGRLFNAIIHRHKPLLIDMNKVYRQTNLENLDQAFSVAERDLGVTRLLDPEDVDVPQPDEKSIITYVSSLYDAMPRVPDVQDGELQLRWQEYRELVLLLLQWMRHHTAAFEERRFPSSFEEIEILWSQFLKFKEMELPAKEADKNRSKGIYQSLEGAVQAGQLKVPPGYHPLDVEKEWGKLHVAILEREKQLRSEFERLECLQRIVTKLQMEAGLCEEQLNQADALLQSDVRLLAAGKVPQRAGEVERDLDKADSMIRLLFNDVQTLKDGRHPQGEQMYRRVYRLHERLVAIRTEYNLRLKAGVAAPATQVAQVTLQSVQRRPELEDSTLRYLQDLLAWVEENQHRVDGAEWGVDLPSVEAQLGSHRGLHQSIEEFRAKIERARSDEGQLSPATRGAYRDCLGRLDLQYAKLLNSSKARLRSLESLHSFVAAATKELMWLNEKEEEEVGFDWSDRNTNMTAKKESYSALMRELELKEKKIKELQNAGDRLLREDHPARPTVESFQAALQTQWSWMLQLCCCIEAHLKENAAYFQFFSDVREAEGQLQKLQEALRRKYSCDRSATVTRLEDLLQDAQDEKEQLNEYKGHLSGLAKRAKAVVQLKPRHPAHPMRGRLPLLAVCDYKQVEVTVHKGDECQLVGPAQPSHWKVLSSSGSEAAVPSVCFLVPPPNQEAQEAVTRLEAQHQALVTLWHQLHVDMKSLLAWQSLRRDVQLIRSWSLATFRTLKPEEQRQALHSLELHYQAFLRDSQDAGGFGPEDRLMAEREYGSCSHHYQQLLQSLEQGAQEESRCQRCISELKDIRLQLEACETRTVHRLRLPLDKEPARECAQRIAEQQKAQAEVEGLGKGVARLSAEAEKVLALPEPSPAAPTLRSELELTLGKLEQVRSLSAIYLEKLKTISLVIRGTQGAEEVLRAHEEQLKEAQAVPATLPELEATKASLKKLRAQAEAQQPTFDALRDELRGAQEVGERLQQRHGERDVEVERWRERVAQLLERWQAVLAQTDVRQRELEQLGRQLRYYRESADPLGAWLQDARRRQEQIQAMPLADSQAVREQLRQEQALLEEIERHGEKVEECQRFAKQYINAIKDYELQLVTYKAQLEPVASPAKKPKVQSGSESVIQEYVDLRTHYSELTTLTSQYIKFISETLRRMEEEERLAEQQRAEERERLAEVEAALEKQRQLAEAHAQAKAQAEREAKELQQRMQEEVVRREEAAVDAQQQKRSIQEELQQLRQSSEAEIQAKARQAEAAERSRLRIEEEIRVVRLQLEATERQRGGAEGELQALRARAEEAEAQKRQAQEEAERLRRQVQDESQRKRQAEVELASRVKAEAEAAREKQRALQALEELRLQAEEAERRLRQAEVERARQVQVALETAQRSAEAELQSKRASFAEKTAQLERSLQEEHVAVAQLREEAERRAQQQAEAERAREEAERELERWQLKANEALRLRLQAEEVAQQKSLAQAEAEKQKEEAEREARRRGKAEEQAVRQRELAEQELEKQRQLAEGTAQQRLAAEQELIRLRAETEQGEQQRQLLEEELARLQREAAAATQKRQELEAELAKVRAEMEVLLASKARAEEESRSTSEKSKQRLEAEAGRFRELAEEAARLRALAEEAKRQRQLAEEDAARQRAEAERVLAEKLAAIGEATRLKTEAEIALKEKEAENERLRRLAEDEAFQRRRLEEQAAQHKADIEERLAQLRKASDSELERQKGLVEDTLRQRRQVEEEILALKASFEKAAAGKAELELELGRIRSNAEDTLRSKEQAELEAARQRQLAAEEERRRREAEERVQKSLAAEEEAARQRKAALEEVERLKAKVEEARRLRERAEQESARQLQLAQEAAQKRLQAEEKAHAFAVQQKEQELQQTLQQEQSVLDQLRGEAEAARRAAEEAEEARVQAEREAAQSRRQVEEAERLKQSAEEQAQARAQAQAAAEKLRKEAEQEAARRAQAEQAALRQKQAADAEMEKHKKFAEQTLRQKAQVEQELTTLRLQLEETDHQKNLLDEELQRLKAEATEAARQRSQVEEELFSVRVQMEELSKLKARIEAENRALILRDKDNTQRFLQEEAEKMKQVAEEAARLSVAAQEAARLRQLAEEDLAQQRALAEKMLKEKMQAVQEATRLKAEAELLQQQKELAQEQARRLQEDKEQMAQQLAEETQGFQRTLEAERQRQLEMSAEAERLKLRVAEMSRAQARAEEDAQRFRKQAEEIGEKLHRTELATQEKVTLVQTLEIQRQQSDHDAERLREAIAELEREKEKLQQEAKLLQLKSEEMQTVQQEQLLQETQALQQSFLSEKDSLLQRERFIEQEKAKLEQLFQDEVAKAQQLREEQQRQQQQMEQERQRLVASMEEARRRQHEAEEGVRRKQEELQQLEQQRRQQEELLAEENQRLREQLQLLEEQHRAALAHSEEVTASQVAATKTLPNGRDALDGPAAEAEPEHSFDGLRRKVSAQRLQEAGILSAEELQRLAQGHTTVDELARREDVRHYLQGRSSIAGLLLKATNEKLSVYAALQRQLLSPGTALILLEAQAASGFLLDPVRNRRLTVNEAVKEGVVGPELHHKLLSAERAVTGYKDPYTGQQISLFQAMQKGLIVREHGIRLLEAQIATGGVIDPVHSHRVPVDVAYRRGYFDEEMNRVLADPSDDTKGFFDPNTHENLTYLQLLERCVEDPETGLCLLPLTDKAAKGGELVYTDSEARDVFEKATVSAPFGKFQGKTVTIWEIINSEYFTAEQRRDLLRQFRTGRITVEKIIKIIITVVEEQEQKGRLCFEGLRSLVPAAELLESRVIDRELYQQLQRGERSVRDVAEVDTVRRALRGANVIAGVWLEEAGQKLSIYNALKKDLLPSDMAVALLEAQAGTGHIIDPATSARLTVDEAVRAGLVGPEFHEKLLSAEKAVTGYRDPYTGQSVSLFQALKKGLIPREQGLRLLDAQLSTGGIVDPSKSHRVPLDVACARGCLDEETSRALSAPRADAKAYSDPSTGEPATYGELQQRCRPDQLTGLSLLPLSEKAARARQEELYSELQARETFEKTPVEVPVGGFKGRTVTVWELISSEYFTAEQRQELLRQFRTGKVTVEKVIKILITIVEEVETLRQERLSFSGLRAPVPASELLASGVLSRAQFEQLKDGKTTVKDLSELGSVRTLLQGSGCLAGIYLEDTKEKVSIYEAMRRGLLRATTAALLLEAQAATGFLVDPVRNQRLYVHEAVKAGVVGPELHEQLLSAEKAVTGYRDPYSGSTISLFQAMQKGLVLRQHGIRLLEAQIATGGIIDPVHSHRVPVDVAYQRGYFSEEMNRVLADPSDDTKGFFDPNTHENLTYRQLLERCVEDPETGLRLLPLKGAEKAEVVETTQVYTEEETRRAFEETQIDIPGGGSHGGSTMSLWEVMQSDLIPEEQRAQLMADFQAGRVTKERMIIIIIEIIEKTEIIRQQGLASYDYVRRRLTAEDLFEARIISLETYNLLREGTRSLREALEAESAWCYLYGTGSVAGVYLPGSRQTLSIYQALKKGLLSAEVARLLLEAQAATGFLLDPVKGERLTVDEAVRKGLVGPELHDRLLSAERAVTGYRDPYTEQTISLFQAMKKELIPTEEALRLLDAQLATGGIVDPRLGFHLPLEVAYQRGYLNKDTHDQLSEPSEVRSYVDPSTDERLSYTQLLRRCRRDDGTGQLLLPLSDARKLTFRGLRKQITMEELVRSQVMDEATALQLREGLTSIEEVTKNLQKFLEGTSCIAGVFVDATKERLSVYQAMKKGIIRPGTAFELLEAQAATGYVIDPIKGLKLTVEEAVRMGIVGPEFKDKLLSAERAVTGYKDPYSGKLISLFQAMKKGLILKDHGIRLLEAQIATGGIIDPEESHRLPVEVAYKRGLFDEEMNEILTDPSDDTKGFFDPNTEENLTYLQLMERCITDPQTGLCLLPLKEKKRERKTSSKSSVRKRRVVIVDPETGKEMSVYEAYRKGLIDHQTYLELSEQECEWEEITISSSDGVVKSMIIDRRSGRQYDIDDAIAKNLIDRSALDQYRAGTLSITEFADMLSGNAGGFRSRSSSVGSSSSYPISPAVSRTQLASWSDPTEETGPVAGILDTETLEKVSITEAMHRNLVDNITGQRLLEAQACTGGIIDPSTGERFPVTDAVNKGLVDKIMVDRINLAQKAFCGFEDPRTKTKMSAAQALKKGWLYYEAGQRFLEVQYLTGGLIEPDTPGRVPLDEALQRGTVDARTAQKLRDVGAYSKYLTCPKTKLKISYKDALDRSMVEEGTGLRLLEAAAQSTKGYYSPYSVSGSGSTAGSRTGSRTGSRAGSRRGSFDATGSGFSMTFSSSSYSSSGYGRRYASGSSASLGGPESAVA

SEQ ID NO: 58225 - protein, 500 aa, Homo sapiens
MATVIPGDLSEVRDTQKVPSGKRKRGETKPRKNFPCQLCDKAFNSVEKLKVHSYSHTGERPYKCIQQDCTKAFVSKYKLQRHMATHSPEKTHKCNYCEKMFHRKDHLKNHLHTHDPNKETFKCEECGKNYNTKLGFKRHLALHAATSGDLTCKVCLQTFESTGVLLEHLKSHAGKSSGGVKEKKHQCEHCDRRFYTRKDVRRHMVVHTGRKDFLCQYCAQRFGRKDHLTRHMKKSHNQELLKVKTEPVDFLDPFTCNVSVPIKDELLPVMSLPSSELLSKPFTNTLQLNLYNTPFQSMQSSGSAHQMITTLPLGMTCPIDMDTVHPSHHLSFKYPFSSTSYAISIPEKEQPLKGEIESYLMELQGGVPSSSQDSQASSSSKLGLDPQIGSLDDGAGDLSLSKSSISISDPLNTPALDFSQLFNFIPLNGPPYNPLSVGSLGMSYSQEEAHSSVSQLPPQTQDLQDPANTIGLGSLHSLSAAFTSSLSTSTTLPRFHQAFQ

SEQ ID NO: 58226 - protein, 418 aa, Homo sapiens
MATHSPEKTHKCNYCEKMFHRKDHLKNHLHTHDPNKETFKCEECGKNYNTKLGFKRHLALHAATSGDLTCKVCLQTFESTGVLLEHLKSHAGKSSGGVKEKKHQCEHCDRRFYTRKDVRRHMVVHTGRKDFLCQYCAQRFGRKDHLTRHMKKSHNQELLKVKTEPVDFLDPFTCNVSVPIKDELLPVMSLPSSELLSKPFTNTLQLNLYNTPFQSMQSSGSAHQMITTLPLGMTCPIDMDTVHPSHHLSFKYPFSSTSYAISIPEKEQPLKGEIESYLMELQGGVPSSSQDSQASSSSKLGLDPQIGSLDDGAGDLSLSKSSISISDPLNTPALDFSQLFNFIPLNGPPYNPLSVGSLGMSYSQEEAHSSVSQLPPQTQDLQDPANTIGLGSLHSLSAAFTSSLSTSTTLPRFHQAFQ

SEQ ID NO: 58227 - protein, 500 aa, Homo sapiens; identical to SEQ ID NO: 58225

SEQ ID NO: 58228 - protein, 463 aa, Homo sapiens
MATFPCQLCGKTFLTLEKFTIHNYSHSRERPYKCVQPDCGKAFVSRYKLMRHMATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 58229 - protein, 463 aa, Homo sapiens; identical to SEQ ID NO: 58228

SEQ ID NO: 58230 - protein, 463 aa, Homo sapiens; identical to SEQ ID NO: 58228

SEQ ID NO: 58231 - protein, 411 aa, Homo sapiens
MATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 58232 - protein, 411 aa, Homo sapiens; identical to SEQ ID NO: 58231

SEQ ID NO: 58233 - protein, 463 aa, Homo sapiens; identical to SEQ ID NO: 58228

SEQ ID NO: 58234 - protein, 463 aa, Homo sapiens; identical to SEQ ID NO: 58228

SEQ ID NO: 58235 - protein, 176 aa, Homo sapiens
MATHSPQKSHQCAHCEKTFNRKDHLKNHLQTHDPNKMAFGCEECGKKYNTMLGYKRHLALHAASSGDLTCGVCALELGSTEVLLDHLKAHAEEKPPSGTKEKKHQCDHCERCFYTRKDVRRHLVVHTGCKDFLCQFCAQRFGRKDHLTRHTKKTHSQELMKESLQTGDLLSTFHTI

SEQ ID NO: 58236 - protein, 463 aa, Homo sapiens; identical to SEQ ID NO: 58228

SEQ ID NO: 58237 - protein, 411 aa, Homo sapiens; identical to SEQ ID NO: 58231

SEQ ID NO: 58238 - protein, 463 aa, Homo sapiens; identical to SEQ ID NO: 58228

SEQ ID NO: 58239 - protein, 252 aa, Homo sapiens
MKESLQTGDLLSTFHTISPSFQLKAAALPPFPLGASAQNGLASSLPAEVHSLTLSPPEQAAQPMQPLPESLASLHPSVSPGSPPPPLPNHKYNTTSTSYSPLASLPLKADTKGFCNISLFEDLPLQEPQSPQKLNPGFDLAKGNAGKVNLPKELPADAVNLTIPASLDLSPLLGFWQLPPPATQNTFGNSTLALGPGESLPHRLSCLGQQQQEPPLAMGTVSLGQLPLPPIPHVFSAGTGSAILPHFHHAFR

SEQ ID NO: 58240 - protein, 496 aa, Homo sapiens
MTTFFTSVPPWIQDAKQEEEVGWKLVPRPRGREAESQVKCQCEISGTPFSNGEKLRPHSLPQPEQRPYSCPQLHCGKAFASKYKLYRHMATHSAQKPHQCMYCDKMFHRKDHLRNHLQTHDPNKEALHCSECGKNYNTKLGYRRHLAMHAASSGDLSCKVCLQTFESTQALLEHLKAHSRRVAGGAKEKKHPCDHCDRRFYTRKDVRRHLVVHTGRKDFLCQYCAQRFGRKDHLTRHVKKSHSQELLKIKTEPVDMLGLLSCSSTVSVKEELSPVLCMASRDVMGTKAFPGMLPMGMYGAHIPTMPSTGVPHSLVHNTLPMGMSYPLESSPISSPAQLPPKYQLGSTSYLPDKLPKVEVDSFLAELPGSLSLSSAEPQPASPQPAAAAALLDEALLAKSPANLSEALCAANVDFSHLLGFLPLNLPPCNPPGATGGLVMGYSQAEAQPLLTTLQAQPQDSPGAGGPLNFGPLHSLPPVFTSGLSSTTLPRFHQAFQ

SEQ ID NO: 58241 - protein, 168 aa, Homo sapiens
MQAQQYQQQRRKFAAAFLAFIFILAAVDTAEAGKKEKPEKKVKKSDCGEWQWSVCVPTSGDCGLGTREGTRTGAECKQTMKTQRCKIPCNWKKQFGAECKYQFQAWGECDLNTALKTRTGSLKRALHNAECQKTVTISKPCGKLTKPKPQAESKKKKKEGKKQEKMLD

SEQ ID NO: 58242 - protein, 505 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 58243 - protein, 514 aa, Homo sapiens
MICEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 58244 - protein, 514 aa, Homo sapiens
MVEEVQKHSVHTLVFRSLKRTHDMFVADNGKPVPLDEESHKRKMAIKLRNEYGPVLHMPTSKENLKEKGPQNATDSYVHKQYPANQGQEVEYFVAGTHPYPPGPGVALTADTKIQRMPSESAAQSLAVALPLQTKADANRTAPSGSEYRHPGASDRPQPTAMNSIVMETGNTKNSALMAKKAPTMPKPQWHPPWKLYRVISGHLGWVRCIAVEPGNQWFVTGSADRTIKIWDLASGKLKLSLTGHISTVRGVIVSTRSPYLFSCGEDKQVKCWDLEYNKVIRHYHGHLSAVYGLDLHPTIDVLVTCSRDSTARIWDVRTKASVHTLSGHTNAVATVRCQAAEPQIITGSHDTTIRLWDLVAGKTRVTLTNHKKSVRAVVLHPRHYTFASGSPDNIKQWKFPDGSFIQNLSGHNAIINTLTVNSDGVLVSGADNGTMHLWDWRTGYNFQRVHAAVQPGSLDSESGIFACAFDQSESRLLTAEADKTIKVYREDDTATEETHPVSWKPEIIKRKRF

SEQ ID NO: 58245 - protein, 1873 aa, Homo sapiens
MWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 58246 - protein, 1896 aa, Homo sapiens
MPLPPRSLQVLLLLLLLLLLLPGMWAEAGLPRAGGGSQPPFRTFSASDWGLTHLVVHEQTGEVYVGAVNRIYKLSGNLTLLRAHVTGPVEDNEKCYPPPSVQSCPHGLGSTDNVNKLLLLDYAANRLLACGSASQGICQFLRLDDLFKLGEPHHRKEHYLSSVQEAGSMAGVLIAGPPGQGQAKLFVGTPIDGKSEYFPTLSSRRLMANEEDADMFGFVYQDEFVSSQLKIPSDTLSKFPAFDIYYVYSFRSEQFVYYLTLQLDTQLTSPDAAGEHFFTSKIVRLCVDDPKFYSYVEFPIGCEQAGVEYRLVQDAYLSRPGRALAHQLGLAEDEDVLFTVFAQGQKNRVKPPKESALCLFTLRAIKEKIKERIQSCYRGEGKLSLPWLLNKELGCINSPLQIDDDFCGQDFNQPLGGTVTIEGTPLFVDKDDGLTAVAAYDYRGRTVVFAGTRSGRIRKILVDLSNPGGRPALAYESVVAQEGSPILRDLVLSPNHQYLYAMTEKQVTRVPVESCVQYTSCELCLGSRDPHCGWCVLHSICSRRDACERADEPQRFAADLLQCVQLTVQPRNVSVTMSQVPLVLQAWNVPDLSAGVNCSFEDFTESESVLEDGRIHCRSPSAREVAPITRGQGDQRVVKLYLKSKETGKKFASVDFVFYNCSVHQSCLSCVNGSFPCHWCKYRHVCTHNVADCAFLEGRVNVSEDCPQILPSTQIYVPVGVVKPITLAARNLPQPQSGQRGYECLFHIPGSPARVTALRFNSSSLQCQNSSYSYEGNDVSDLPVNLSVVWNGNFVIDNPQNIQAHLYKCPALRESCGLCLKADPRFECGWCVAERRCSLRHHCAADTPASWMHARHGSSRCTDPKILKLSPETGPRQGGTRLTITGENLGLRFEDVRLGVRVGKVLCSPVESEYISAEQIVCEIGDASSVRAHDALVEVCVRDCSPHYRALSPKRFTFVTPTFYRVSPSRGPLSGGTWIGIEGSHLNAGSDVAVSVGGRPCSFSWRNSREIRCLTPPGQSPGSAPIIININRAQLTNPEVKYNYTEDPTILRIDPEWSINSGGTLLTVTGTNLATVREPRIRAKYGGIERENGCLVYNDTTMVCRAPSVANPVRSPPELGERPDELGFVMDNVRSLLVLNSTSFLYYPDPVLEPLSPTGLLELKPSSPLILKGRNLLPPAPGNSRLNYTVLIGSTPCTLTVSETQLLCEAPNLTGQHKVTVRAGGFEFSPGTLQVYSDSLLTLPAIVGIGGGGGLLLLVIVAVLIAYKRKSRDADRTLKRLQLQMDNLESRVALECKEAFAELQTDIHELTNDLDGAGIPFLDYRTYAMRVLFPGIEDHPVLKEMEVQANVEKSLTLFGQLLTKKHFLLTFIRTLEAQRSFSMRDRGNVASLIMTALQGEMEYATGVLKQLLSDLIEKNLESKNHPKLLLRRTESVAEKMLTNWFTFLLYKFLKECAGEPLFMLYCAIKQQMEKGPIDAITGEARYSLSEDKLIRQQIDYKTLTLNCVNPENENAPEVPVKGLDCDTVTQAKEKLLDAAYKGVPYSQRPKAADMDLEWRQGRMARIILQDEDVTTKIDNDWKRLNTLAHYQVTDGSSVALVPKQTSAYNISNSSTFTKSLSRYESMLRTASSPDSLRSRTPMITPDLESGTKLWHLVKNHDHLDQREGDRGSKMVSEIYLTRLLATKGTLQKFVDDLFETIFSTAHRGSALPLAIKYMFDFLDEQADKHQIHDADVRHTWKSNCLPLRFWVNVIKNPQFVFDIHKNSITDACLSVVAQTFMDSCSTSEHKLGKDSPSNKLLYAKDIPNYKSWVERYYADIAKMPAISDQDMSAYLAEQSRLHLSQFNSMSALHEIYSYITKYKDEILAALEKDEQARRQRLRSKLEQVVDTMALSS

SEQ ID NO: 58247 - protein, 1894 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYFLTVQPETPEGVAINSAGDLFYTSRIVRLCKDDPKFHSYVSLPFGCTRAGVEYRLLQAAYLAKPGDSLAQAFNITSQDDVLFAIFSKGQKQYHHPPDDSALCAFPIRAINLQIKERLQSCYQGEGNLELNWLLGKDVQCTKAPVPIDDNFCGLDINQPLGGSTPVEGLTLYTTSRDRMTSVASYVYNGYSVVFVGTKSGKLKKIRADGPPHGGVQYEMVSVLKDGSPILRDMAFSIDQRYLYVMSERQVTRVPVESCEQYTTCGECLSSGDPHCGWCALHNMCSRRDKCQQAWEPNRFAASISQCVSLAVHPSSISVSEHSRLLSLVVSDAPDLSAGIACAFGNLTEVEGQVSGSQVICISPGPKDVPVIPLDQDWFGLELQLRSKETGKIFVSTEFKFYNCSAHQLCLSCVNSAFRCHWCKYRNLCTHDPTTCSFQEGRINISEDCPQLVPTEEILIPVGEVKPITLKARNLPQPQSGQRGYECVLNIQGAIHRVPALRFNSSSVQCQNSSYQYDGMDISNLAVDFAVVWNGNFIIDNPQDLKVHLYKCAAQRESCGLCLKADRKFECGWCSGERRCTLHQHCTSPSSPWLDWSSHNVKCSNPQITEILTVSGPPEGGTRVTIHGVNLGLDFSEIAHHVQVAGVPCTPLPGEYIIAEQIVCEMGHALVGTTSGPVRLCIGECKPEFMTKSHQQYTFVNPSVLSLNPIRGPESGGTMVTITGHYLGAGSSVAVYLGNQTCEFYGRSMSEIVCVSPPSSNGLGPVPVSVSVDRAHVDSNLQFEYIDDPRVQRIEPEWSIASGHTPLTITGFNLDVIQEPRIRVKFNGKESVNVCKVVNTTTLTCLAPSLTTDYRPGLDTVERPDEFGFVFNNVQSLLIYNDTKFIYYPNPTFELLSPTGVLDQKPGSPIILKGKNLCPPASGGAKLNYTVLIGETPCAVTVSETQLLCEPPNLTGQHKVMVHVGGMVFSPGSVSVISDSLLTLPAIVSIAAGGSLLLIIVIIVLIAYKRKSRENDLTLKRLQMQMDNLESRVALECKEAFAELQTDINELTSDLDRSGIPYLDYRTYAMRVLFPGIEDHPVLRELEVQGNGQQHVEKALKLFAQLINNKVFLLTFIRTLELQRSFSMRDRGNVASLIMTGLQGRLEYATDVLKQLLSDLIDKNLENKNHPKLLLRRTESVAEKMLTNWFAFLLHKFLKECAGEPLFMLYCAIKQQMEKGPIDAITGEARYSLSEDKLIRQQIEYKTLILNCVNPDNENSPEIPVKVLNCDTITQVKEKILDAVYKNVPYSQRPRAVDMDLEWRQGRIARVVLQDEDITTKIEGDWKRLNTLMHYQVSDRSVVALVPKQTSSYNIPASASISRTSISRYDSSFRYTGSPDSLRSRAPMITPDLESGVKVWHLVKNHDHGDQKEGDRGSKMVSEIYLTRLLATKGTLQKFVDDLFETLFSTVHRGSALPLAIKYMFDFLDEQADRHSIHDTDVRHTWKSNCLPLRFWVNVIKNPQFVFDIHKGSITDACLSVVAQTFMDSCSTSEHRLGKDSPSNKLLYAKDIPSYKSWVERYYADIAKLPAISDQDMNAYLAEQSRLHAVEFNMLSALNEIYSYVSKYSEELIGALEQDEQARRQRLAYKVEQLINAMSIES

SEQ ID NO: 58248 - protein, 1894 aa, Homo sapiens
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKIRVDGPRGNALQYETVQVVDPGPVLRDMAFSKDHEQLYIMSERQLTRVPVESCGQYQSCGECLGSGDPHCGWCVLHNTCTRKERCERSKEPRRFASEMKQCVRLTVHPNNISVSQYNVLLVLETYNVPELSAGVNCTFEDLSEMDGLVVGNQIQCYSPAAKEVPRIITENGDHHVVQLQLKSKETGMTFASTSFVFYNCSVHNSCLSCVESPYRCHWCKYRHVCTHDPKTCSFQEGRVKLPEDCPQLLRVDKILVPVEVIKPITLKAKNLPQPQSGQRGYECILNIQGSEQRVPALRFNSSSVQCQNTSYSYEGMEINNLPVELTVVWNGHFNIDNPAQNKVHLYKCGAMRESCGLCLKADPDFACGWCQGPGQCTLRQHCPAQESQWLELSGAKSKCTNPRITEIIPVTGPREGGTKVTIRGENLGLEFRDIASHVKVAGVECSPLVDGYIPAEQIVCEMGEAKPSQHAGFVEICVAVCRPEFMARSSQLYYFMTLTLSDLKPSRGPMSGGTQVTITGTNLNAGSNVVVMFGKQPCLFHRRSPSYIVCNTTSSDEVLEMKVSVQVDRAKIHQDLVFQYVEDPTIVRIEPEWSIVSGNTPIAVWGTHLDLIQNPQIRAKHGGKEHINICEVLNATEMTCQAPALALGPDHQSDLTERPEEFGFILDNVQSLLILNKTNFTYYPNPVFEAFGPSGILELKPGTPIILKGKNLIPPVAGGNVKLNYTVLVGEKPCTVTVSDVQLLCESPNLIGRHKVMARVGGMEYSPGMVYIAPDSPLSLPAIVSIAVAGGLLIIFIVAVLIAYKRKSRESDLTLKRLQMQMDNLESRVALECKEAFAELQTDIHELTSDLDGAGIPFLDYRTYTMRVLFPGIEDHPVLRDLEVPGYRQERVEKGLKLFAQLINNKVFLLSFIRTLESQRSFSMRDRGNVASLIMTVLQSKLEYATDVLKQLLADLIDKNLESKNHPKLLLRRTESVAEKMLTNWFTFLLYKFLKECAGEPLFSLFCAIKQQMEKGPIDAITGEARYSLSEDKLIRQQIDYKTLVLSCVSPDNANSPEVPVKILNCDTITQVKEKILDAIFKNVPCSHRPKAADMDLEWRQGSGARMILQDEDITTKIENDWKRLNTLAHYQVPDGSVVALVSKQVTAYNAVNNSTVSRTSASKYENMIRYTGSPDSLRSRTPMITPDLESGVKMWHLVKNHEHGDQKEGDRGSKMVSEIYLTRLLATKGTLQKFVDDLFETIFSTAHRGSALPLAIKYMFDFLDEQADKHGIHDPHVRHTWKSNCLPLRFWVNMIKNPQFVFDIHKNSITDACLSVVAQTFMDSCSTSEHRLGKDSPSNKLLYAKDIPSYKNWVERYYSDIGKMPAISDQDMNAYLAEQSRMHMNEFNTMSALSEIFSYVGKYSEEILGPLDHDDQCGKQKLAYKLEQVITLMSLDS

SEQ ID NO: 58249 - protein, 1894 aa, Homo sapiens; identical to SEQ ID NO: 58248

SEQ ID NO: 58250 - protein, 522 aa, Homo sapiens
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKSFGTGPQGGITQEWIGVEGDPPGANIASQEQMLCVYLQCSSHKAISDQRVQPLLCCFLNVPGNSS

SEQ ID NO: 58251 - protein, 492 aa, Homo sapiens
MKAMPWNWTCLLSHLLMVGMGSSTLLTRQPAPLSQKQRSFVTFRGEPAEGFNHLVVDERTGHIYLGAVNRIYKLSSDLKVLVTHETGPDEDNPKCYPPRIVQTCNEPLTTTNNVNKMLLIDYKENRLIACGSLYQGICKLLRLEDLFKLGEPYHKKEHYLSGVNESGSVFGVIVSYSNLDDKLFIATAVDGKPEYFPTISSRKLTKNSEADGMFAYVFHDEFVASMIKIPSDTFTIIPDFDIYYVYGFSSGNFVYFLTLQPEMVSPPGSTTKEQVYTSKLVRLCKEDTAFNSYVEVPIGCERSGVEYRLLQAAYLSKAGAVLGRTLGVHPDDDLLFTVFSKGQKRKMKSLDESALCIFILKQINDRIKERLQSCYRGEGTLDLAWLKVKDIPCSSALLTIDDNFCGLDMNAPLGVSDMVRGIPVFTEDRDRMTSVIAYVYKNHSLAFVGTKSGKLKKMPGTSLCPTLELQTGPRSHRATVTLELLFSSCSSN

SEQ ID NO: 58252 - protein, 1838 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQCRDSQDPYCGWCVVEGRCTRKAECPRAEEASHWLWSRSKSCVAVTSAQPQNMSRRAQGEVQLTVSPLPALSEEDELLCLFGESPPHPARVEGEAVICNSPSSIPVTPPGQDHVAVTIQLLLRRGNIFLTSYQYPFYDCRQAMSLEENLPCISCVSNRWTCQWDLRYHECREASPNPEDGIVRAHMEDSCPQFLGPSPLVIPMNHETDVNFQGKNLDTVKGSSLHVGSDLLKFMEPVTMQESGTFAFRTPKLSHDANETLPLHLYVKSYGKNIDSKLHVTLYNCSFGRSDCSLCRAANPDYRCAWCGGQSRCVYEALCNTTSECPPPVITRIQPETGPLGGGIRITILGSNLGVQAGDIQRISVAGRNCSFQPERYSVSTRIVCVIEAAETPFTGGVEVDVFGKLGRSPPNVQFTFQQPKPLSVEPQQGPQAGGTTLTIHGTHLDTGSQEDVRVTLNGVPCKVTKFGAQLQCVTGPQATRGQMLLEVSYGGSPVPNPGIFFTYRENPVLRAFEPLRSFASGGRSINVTGQGFSLIQRFAMVVIAEPLQSWQPPREAESLQPMTVVGTDYVFHNDTKVVFLSPAVPEEPEAYNLTVLIEMDGHRALLRTEAGAFEYVPDPTFENFTGGVKKQVNKLIHARGTNLNKAMTLQEAEAFVGAERCTMKTLTETDLYCEPPEVQPPPKRRQKRDTTHNLPEFIVKFGSREWVLGRVEYDTRVSDVPLSLILPLVIVPMVVVIAVSVYCYWRKSQQAEREYEKIKSQLEGLEESVRDRCKKEFTDLMIEMEDQTNDVHEAGIPVLDYKTYTDRVFFLPSKDGDKDVMITGKLDIPEPRRPVVEQALYQFSNLLNSKSFLINFIHTLENQREFSARAKVYFASLLTVALHGKLEYYTDIMHTLFLELLEQYVVAKNPKLMLRRSETVVERMLSNWMSICLYQYLKDSAGEPLYKLFKAIKHQVEKGPVDAVQKKAKYTLNDTGLLGDDVEYAPLTVSVIVQDEGVDAIPVKVLNCDTISQVKEKIIDQVYRGQPCSCWPRPDSVVLEWRPGSTAQILSDLDLTSQREGRWKRVNTLMHYNVRDGATLILSKVGVSQQPEDSQQDLPGERHALLEEENRVWHLVRPTDEVDEGKSKRGSVKEKERTKAITEIYLTRLLSVKGTLQQFVDNFFQSVLAPGHAVPPAVKYFFDFLDEQAEKHNIQDEDTIHIWKTNSLPLRFWVNILKNPHFIFDVHVHEVVDASLSVIAQTFMDACTRTEHKLSRDSPSNKLLYAKEISTYKKMVEDYYKGIRQMVQVSDQDMNTHLAEISRAHTDSLNTLVALHQLYQYTQKYYDEIINALEEDPAAQKMQLAFRLQQIAAALENKVTDL

SEQ ID NO: 58253 - protein, 347 aa, Homo sapiens [sequence omitted]

SEQ ID NO: 58254 - protein, 160 aa, Homo sapiens
GPDVTAGGPVEARQHPYALQCPGWSHPHPVQGGGLPAAGGQPAGPAWGAPCPPGGGEPGVAPGAADRRGGRGQVQERQREREGADEGHHRDLPDAAALSQGHTAAVCGQLLPERAGLGTRCHLQSSTSSTSWTSRQRSTTSRMKTPSTSGRRTAYRSGSG

SEQ ID NO: 58255 - protein, 522 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQLPPAAEPASGVHCRVSSDLKMCLTLPRWGQLASASAHAPAAASMP

SEQ ID NO: 58256 - protein, 162 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGP

SEQ ID NO: 58257 - protein, 477 aa, Homo sapiens
MALQLWALTLLGLLGAGASLRPRKLDFFRSEKELNHLAVDEASGVVYLGAVNALYQLDAKLQLEQQVATGPALDNKKCTPPIEASQCHEAEMTDNVNQLLLLDPPRKRLVECGSLFKGICALRALSNISLRLFYEDGSGEKSFVASNDEGVATVGLVSSTGPGGDRVLFVGKGNGPHDNGIIVSTRLLDRTDSREAFEAYTDHATYKAGYLSTNTQQFVAAFEDGPYVFFVFNQQDKHPARNRTLLARMCREDPNYYSYLEMDLQCRDPDIHAAAFGTCLAASVAAPGSGRVLYAVFSRDSRSSGGPGAGLCLFPLDKVHAKMEANRNACYTGTREARDIFYKPFHGDIQCGGHAPGSSKSFPCGSEHLPYPLGSRDGLRGTAVLQRGGLNLTAVTVAAENNHTVAFLGTSDGRILKVYLTPDGTSSEYDSILVEINKRVKRDLVLSGDLGSLYAMTQDKVFRLPVQECLSYPTCTQ

SEQ ID NO: 58258 - protein, 1838 aa, Homo sapiens; identical to SEQ ID NO: 58252

SEQ ID NO: 58259 - protein, 1909 aa, Homo sapiens
MCHAAQETPLLHHFMAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 58260 - protein, 258 aa, Homo sapiens
  MOD_RES (1)..(1): Any amino acid
XSLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTEWRSGLAGHLTLSDEDLTSVTQNHWKRLNTLQHYKVPDGATVGLVPQLHRGSTISQSL

SEQ ID NO: 58261 - protein, 176 aa, Homo sapiens
  MOD_RES (1)..(1): Any amino acid
XASQGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRVRAVPAAAAGRGLRRKGLWGKPRGLCTELWVGSGSIMGAPSPPSSCLAPPLPPEQDSPVNKLLYAREIP

SEQ ID NO: 58262 - protein, 163 aa, Homo sapiens
  MOD_RES (1)..(1): Any amino acid
XKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGESESLGPDLGPLESRLGR

SEQ ID NO: 58263 - protein, 988 aa, Homo sapiens
MCHAAQETPLLHHFMDSPESYPCGDEHTPSPIAGRQPLEVQPLLKLGQPVSAVAALQADGHMIAFLGDTQGQLYKVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTGGCGGGGTGYPRGLNSHLGASWPRRPHDGDDRPQQRPGGQRDPLPGLPHLRRARLLPWPWRLPAAAQA

SEQ ID NO: 58264 - protein, 224 aa, Homo sapiens
MCHAAQETPLLHHFMVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPACLPPSTAGWSCLENFGDCRPPWRRQQGIQASSTARPTRSSP

SEQ ID NO: 58265 - protein, 1562 aa, Homo sapiens
MCHAAQETPLLHHFMDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 58266 - protein, 1932 aa, Homo sapiens
MELTPASSLTCSLLSPRLPGSFPQLRRVPPCSRPWLPKAPVMARWPPFGLCLLLLLLSPPPLPLTGAHRFSAPNTTLNHLALAPGRGTLYVGAVNRLFQLSPELQLEAVAVTGPVIDSPDCVPFRDPAECPQAQLTDNANQLLLVSSRAQELVACGQVRQGVCETRRLGDVAEVLYQAEDPGDGQFVAANTPGVATVGLVVPLPGRDLLLVARGLAGKLSAGVPPLAIRQLAGSQPFSSEGLGRLVVGDFSDYNNSYVGAFADARSAYFVFRRRGARAQAEYRSYVARVCLGDTNLYSYVEVPLACQGQGLIQAAFLAPGTLLGVFAAGPRGTQAALCAFPMVELGASMEQARRLCYTAGGRGPSGAEEATVEYGVTSRCVTLPLDSPESYPCGDEHTPSPIAGRQPLEVQPLLKLGQPVSAVAALQADGHMIAFLGDTQGQLYKVFLHGSQGQVYHSQQVGPPGSAISPDLLLDSSGSHLYVLTAHQVDRIPVAACPQFPDCASCLQAQDPLCGWCVLQGRCTRKGQCGRAGQLNQWLWSYEEDSHCLHIQSLLPGHHPRQEQGQVTLSVPRLPILDADEYFHCAFGDYDSLAHVEGPHVACVTPPQDQVPLNPPGTDHVTVPLALMFEDVTVAATNFSFYDCSAVQALEAAAPCRACVGSIWRCHWCPQSSHCVYGEHCPEGERTIYSAQEVDIQVRGPGACPQVEGLAGPHLVPVGWESHLALRVRNLQHFRGLPASFHCWLELPGELRGLPATLEETAGDSGLIHCQAHQFYPSMSQRELPVPIYVTQGEAQRLDNTHALYVILYDCAMGHPDCSHCQAANRSLGCLWCADGQPACRYGPLCPPGAVELLCPAPSIDAVEPLTGPPEGGLALTILGSNLGRAFADVQYAVSVASRPCNPEPSLYRTSARIVCVTSPAPNGTTGPVRVAIKSQPPGISSQHFTYQDPVLLSLSPRWGPQAGGTQLTIRGQHLQTGGNTSAFVGGQPCPILEPVCPEAIVCRTRPQAAPGEAAVLVVFGHAQRTLLASPFRYTANPQLVAAEPSASFRGGGRLIRVRGTGLDVVQRPLLSVWLEADAEVQASRAQPQDPQPRRSCGAPAADPQACIQLGGGLLQCSTVCSVNSSSLLLCRSPAVPDRAHPQRVFFTLDNVQVDFASASGGQGFLYQPNPRLAPLSREGPARPYRLKPGHVLDVEGEGLNLGISKEEVRVHIGRGECLVKTLTRTHLYCEPPAHAPQPANGSGLPQFVVQMGNVQLALGPVQYEAEPPLSAFPVEAQAGVGMGAAVLIAAVLLLTLMYRHKSKQALRDYQKVLVQLESLETGVGDQCRKEFTDLMTEMTDLSSDLEGSGIPFLDYRTYAERAFFPGHGGCPLQPKPEGPGEDGHCATVRQGLTQLSNLLNSKLFLLTLIHTLEEQPSFSQRDRCHVASLLSLALHGKLEYLTDIMRTLLGDLAAHYVHRNPKLMLRRTETMVEKLLTNWLSICLYAFLREVAGEPLYMLFRAIQYQVDKGPVDAVTGKAKRTLNDSRLLREDVEFQPLTLMVLVGPGAGGAAGSSEMQRVPARVLDTDTITQVKEKVLDQVYKGTPFSQRPSVHALDLEWRSGLAGHLTLSDEDLTSVTQNHWKRLNTLQHYKVPDGATVGLVPQLHRGSTISQSLAQRCPLGENIPTLEDGEEGGVCLWHLVKATEEPEGAKVRCSSLREREPARAKAIPEIYLTRLLSMKGTLQKFVDDTFQAILSVNRPIPIAVKYLFDLLDELAEKHGIEDPGTLHIWKTNSLLLRFWVNALKNPQLIFDVRVSDNVDAILAVIAQTFIDSCTTSEHKVGRDSPVNKLLYAREIPRYKQMVERYYADIRQSSPASYQEMNSALAELSGNYTSAPHCLEALQELYNHIHRYYDQIISALEEDPVGQKLQLACRLQQVAALVENKVTDL

SEQ ID NO: 58267 - protein, 1925 aa, Homo sapiens
MAPRAAGGAPLSARAAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRCTLQQDCTNSSQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCMWSDGCRLRGPLQPMAGTCPAPEIHAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLSEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNSLPLRFWVNILKNPQFVFDIDKTDHIDACLSVIAQAFIDACSISDLQLGKDSPTNKLLYAKEIPEYRKIVQRYYKQIQDMTPLSEQEMNAHLAEESRKYQNEFNTNVAMAEIYKYAKRYRPQIMAALEANPTARRTQLQHKFEQVVALMEDNIYECYSEA

SEQ ID NO: 58268 - protein, 1785 aa, Homo sapiens
MAPRAAGGAPLSARAAAASPPPFQTPPRCPVPLLLLLLLGAARAGALEIQRRFPSPTPTNNFALDGAAGTVYLAAVNRLYQLSGANLSLEAEAAVGPVPDSPLCHAPQLPQASCEHPRRLTDNYNKILQLDPGQGLVVVCGSIYQGFCQLRRRGNISAVAVRFPPAAPPAEPVTVFPSMLNVAANHPNASTVGLVLPPAAGAGGSRLLVGATYTGYGSSFFPRNRSLEDHRFENTPEIAIRSLDTRGDLAKLFTFDLNPSDDNILKIKQGAKEQHKLGFVSAFLHPSDPPPGAQSYAYLALNSEARAGDKESQARSLLARICLPHGAGGDAKKLTESYIQLGLQCAGGAGRGDLYSRLVSVFPARERLFAVFERPQGSPAARAAPAALCAFRFADVRAAIRAARTACFVEPAPDVVAVLDSVVQGTGPACERKLNIQLQPEQLDCGAAHLQHPLSILQPLKATPVFRAPGLTSVAVASVNNYTAVFLGTVNGRLLKINLNESMQVVSRRVVTVAYGEPVHHVMQFDPADSGYLYLMTSHQMARVKVAACNVHSTCGDCVGAADAYCGWCALETRCTLQQDCTNSSQQHFWTSASEGPSRCPAMTVLPSEIDVRQEYPGMILQISGSLPSLSGMEMACDYGNNIRTVARVPGPAFGHQIAYCNLLPRDQFPPFPPNQDHVTVEMSVRVNGRNIVKANFTIYDCSRTAQVYPHTACTSCLSAQWPCFWCSQQHSCVSNQSRCEASPNPTSPQDCPRTLLSPLAPVPTGGSQNILVPLANTAFFQGAALECSFGLEEIFEAVWVNESVVRCDQVVLHTTRKSQVFPLSLQLKGRPARFLDSPEPMTVMVYNCAMGSPDCSQCLGREDLGHLCMWSDGCRLRGPLQPMAGTCPAPEIHAIEPLSGPLDGGTLLTIRGRNLGRRLSDVAHGVWIGGVACEPLPDRYTVSEEIVCVTGPAPGPLSGVVTVNASKEGKSRDRFSYVLPLVHSLEPTMGPKAGGTRITIHGNDLHVGSELQVLVNDTDPCTELMRTDTSIACTMPEGALPAPVPVCVRFERRGCVHGNLTFWYMQNPVITAISPRRSPVSGGRTITVAGERFHMVQNVSMAVHHIGREPTLCKVLNSTLITCPSPGALSNASAPVDFFINGRAYADEVAVAEELLDPEEAQRGSRFRLDYLPNPQFSTAKREKWIKHHPGEPLTLVIHKEQDSLGLQSHEYRVKIGQVSCDIQIVSDRIIHCSVNESLGAAVGQLPITIQVGNFNQTIATLQLGGSETAIIVSIVICSVLLLLSVVALFVFCTKSRRAERYWQKTLLQMEEMESQIREEIRKGFAELQTDMTDLTKELNRSQGIPFLEYKHFVTRTFFPKCSSLYEERYVLPSQTLNSQGSSQAQETHPLLGEWKIPESCRPNMEEGISLFSSLLNNKHFLIVFVHALEQQKDFAVRDRCSLASLLTIALHGKLEYYTSIMKELLVDLIDASAAKNPKLMLRRTESVVEKMLTNWMSICMYSCLRETVGEPFFLLLCAIKQQINKGSIDAITGKARYTLSEEWLLRENIEAKPRNLNVSFQGCGMDSLSVRAMDTDTLTQVKEKILEAFCKNVPYSQWPRAEDVDLEWFASSTQSYILRDLDDTSVVEDGRKKLNTLAHYKIPEGASLAMSLIDKKDNTLGRVKDLDTEKYFHLVLPTDELAEPKKSHRQSHRKKVLPEIYLTRLLSTKGTLQKFLDDLFKAILSIREDKPPLAVKYFFDFLEEQAEKRGISDPDTLHIWKTNRWRPSSPVLGEHPEEPPVCL

SEQ ID NO: 58269 - protein, 500 aa, Homo sapiens
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 58270 - protein, 337 aa, Homo sapiens
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQSRDEVSPC

SEQ ID NO: 58271 - protein, 427 aa, Homo sapiens
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRSLNNQDENTYVNCLDSQQCHGSSESRRPFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 58272 - protein, 124 aa, Homo sapiens
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDN

SEQ ID NO: 58273 - protein, 222 aa, Homo sapiens
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSA

SEQ ID NO: 58274 - protein, 65 aa, Homo sapiens
  MOD_RES (1)..(1): Any amino acid
XSFTFQAALHHDGRIVFAYKEIPMSVPEISSSQHPVKTGLSDAFMILNPSPDVPGFSAESAKHLW

SEQ ID NO: 58275 - protein, 460 aa, Homo sapiens
MALSVRTLPLRGFLVPRPQPTRSQDAPSPRLPLSSAPAPCRHKNEEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPTCLQHRSCDACMSSDLTFNCSWCHVLQRCSSGFDRYRQEWMDYGCAQEAEGRMCEDFQDEDHDSASPDTSFSPYDGDLTTTSSSLFIDSLTTEDDTKLNPYAGGDGLQNNLSPKTKGTPVHLGTIVGIVLAVLLVAAIILAGIYINGHPTSNAALFFIERRPHHWPAMKFRSHPDHSTYAEVEPSGHEKEGFMEAEQC

SEQ ID NO: 58276 - protein, 240 aa, Homo sapiens
MDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTGLSDAFMILNPSPDVPESRRRSIFEYHRIELDPSKVTSMSAVEFTPLPSPSTTRMKTRM

SEQ ID NO: 58277 - protein, 392 aa, Homo sapiens
MEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 58278 - protein, 480 aa, Homo sapiens
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIERVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 58279 - protein, 529 aa, Homo sapiens
MARFPKADLAAAGVMLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 58280 - protein, 515 aa, Homo sapiens
MLLCHFFTDQFQFADGKPGDQILDWQYGVTQAFPHTEEEVEVDSHAYSHRWKRNLDFLKAVDTNRASVGQDSPEPRSFTDLLLDDGQDNNTQIEEDTDHNYYISRIYGPSDSASRDLWVNIDQMEKDKVKIHGILSNTHRQAARVNLSFDFPFYGHFLREITVATGGFIYTGEVVHRMLTATQYIAPLMANFDPSVSRNSTVRYFDNGTALVVQWDHVHLQDNYNLGSFTFQATLLMDGRIIFGYKEIPVLVTQISSTNHPVKVGLSDAFVVVHRIQQIPNVRRRTIYEYHRVELQMSKITNISAVEMTPLPTCLQFNRCGPCVSSQIGFNCSWCSKLQRCSSGFDRHRQDWVDSGCPEESKEKMCENTEPVETSSRTTTTVGATTTQFRVLTTTRRAVTSQFPTSLPTEDDTKIALHLKDNGASTDDSAAEKKGGTLHAGLIIGILILVLIVATAILVTVYMYHHPTSAASIFFIERRPSRWPAMKFRRGSGHPAYAEVEPVGEKEGFIVSEQC

SEQ ID NO: 58281 - protein, 526 aa, Homo sapiens
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 58282 - protein, 558 aa, Homo sapiens
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 58283 - protein, 526 aa, Homo sapiens
MRCALALSALLLLLSTPPLLPSSPSPSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWVTPAGVGTQTRVEEALRQALTHSLLPAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 58284 - protein, 560 aa, Homo sapiens
MRCALALSALLLLLSTPPLLPSSPSPSPSPSQNETATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLLETVFHHVSQAGLELLTSGDLPTLASQSAGITASSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 58285 - protein, 516 aa, Homo sapiens
MRCALALSALLLLLSTSPSPSQNATQTTTDSSNKTAPTPASSVTIMATDTAQQSTVPTSKANEILASVKATTLGVSSDSPGTTTLAQQVSGPVNTTVARGGGSGNPTTTIESPKSTKSADTTTVATSTATAKPNTTSSQNGAEDTTNSGGKSSHSVTTDLTSTKAEHLTTPHPTSPLSPRQPTSTHPVATPTSSGHDHLMKISSSSSTVAIPGYTFTSPGMTTTLPSSVISQRTQQTSSQMPASSTAPSSQETVQPTSPATALRTPTLPETMSSSPTAASTTHRYPKTPSPTVAHESNWAKCEDLETQTQSEKQLVLNLTGNTLCAGGASDEKLISLICRAVKATFNPAQDKCGIRLASVPGSQTVVVKEITIHTKLPAKDVYERLKDKWDELKEAGVSDMKLGDQGPPEEAEDRFSMPLIITIVCMASFLLLVAALYGCCHQRLSQRKDQQRLTEELQTVENGYHDNPTLEVMETSSEMQEKKVVSLNGELGDSWIVPLDNLTKDDLDEEEDTHL

SEQ ID NO: 58286 - protein, 661 aa, Homo sapiens
MEGARARGAQLRLGERVRPVGRRSAPGRSRFRQPWRPGASDSAPPAGTMAQSRVLLLLLLLPPQLHLGPVLAVRAPGFGRSGGHSLSPEENEFAEEEPVLVLSPEEPGPGPAAVSCPRDCACSQEGVVDCGGIDLREFPGDLPEHTNHLSLQNNQLEKIYPEELSRLHRLETLNLQNNRLTSRGLPEKAFEHLTNLNYLYLANNKLTLAPRFLPNALISVDFAANYLTKIYGLTFGQKPNLRSVYLHNNKLADAGLPDNMFNGSSNVEVLILSSNFLRHVPKHLPPALYKLHLKNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALVGMAQLRELYLTSNRLRSRALGPRAWVDLAHLQLLDIAGNQLTEIPEGLPESLEYLYLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 58287 - protein, 642 aa, Homo sapiens
MEGEEAEQPAWFRQPWRPGASDSAPPAGTMAQSRVLLLLLLLPPQLHLGPVLAVRAPGFGRSGGHSLSPEENEFAEEEPVLVLSPEEPGPGPAAVSCPRDCACSQEGVVDCGGIDLREFPGDLPEHTNHLSLQNNQLEKIYPEELSRLHRLETLNLQNNRLTSRGLPEKAFEHLTNLNYLYLANNKLTLAPRFLPNALISVDFAANYLTKIYGLTFGQKPNLRSVYLHNNKLADAGLPDNMFNGSSNVEVLILSSNFLRHVPKHLPPALYKLHLKNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALVGMAQLRELYLTSNRLRSRALGPRAWVDLAHLQLLDIAGNQLTEIPEGLPESLEYLYLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 58288 - protein, 519 aa, Homo sapiens
MEGARARGAQLRLGERVRPVGRRSAPGRSRFRQPWRPGASDSAPPAGTMAQSRVLLLLLLLPPQLHLGPVLAVRAPGFGRSGGHSLSPEENEFAEEEPVLVLSPEEPGPGPAAVSCPRDCACSQEGVVDCGGIDLREFPGDLPEHTNHLSLQNNKLEKIPPGAFSELSSLRELYLQNNYLTDEGLDNETFWKLSSLEYLDLSSNNLSRVPAGLPRSLVLLHLEKNAIRSVDANVLTPIRSLEYLLLHSNQLREQGIHPLAFQGLKRLHTVHLYNNALERVPSGLPRRVRTLMILHNQITGIGREDFATTYFLEELNLSYNRITSPQVHRDAFRKLRLLRSLDLSGNRLHTLPPGLPRNVHVLKVKRNELAALARGALVGMAQLRELYLTSNRLRSRALGPRAWVDLAHLQLLDIAGNQLTEIPEGLPESLEYLYLQNNKISAVPANAFDSTPNLKGIFLRFNKLAVGSVVDSAFRRLKHLQVLDIEGNLEFGDISKDRGRLGKEKEEEEEEEEEEEETR

SEQ ID NO: 58289 - protein, 364 aa, Homo sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKGTEHASASANGHVSYSAVSRENSSSQDPQTEGTR

SEQ ID NO: 58290 - protein, 372 aa, Homo sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGTEHASASANGHVSYSAVSRENSSSQDPQTEGTR

SEQ ID NO: 58291 - protein, 392 aa, Homo sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSEHHQSCRN

SEQ ID NO: 58292 - protein, 417 aa, Homo sapiens
MARAMAAAWPLLLVALLVLSWPPPGTGDVVVQAPTQVPGFLGDSVTLPCYLQVPNMEVTHVSQLTWARHGESGSMAVFHQTQGPSYSESKRLEFVAARLGAELRNASLRMFGLRVEDEGNYTCLFVTFPQGSRSVDIWLRVLAKPQNTAEVQKVQLTGEPVPMARCVSTGGRPPAQITWHSDLGGMPNTSQVPGFLSGTVTVTSLWILVPSSQVDGKNVTCKVEHESFEKPQLLTVNLTVYYPPEVSISGYDNNWYLGQNEATLTCDARSNPEPTGYNWSTTMGPLPPFAVAQGAQLLIRPVDKPINTTLICNVTNALGARQAELTVQVKEGPPSEHSGISRNAIIFLVLGILVFLILLGIGIYFYWSKCSREVLWHCHLCPSSTEHASASANGHVSYSAVSRENSSSQDPQTEGTR

SEQ ID NO: 58293 - protein, 517 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEFPYTPSPPEHGRRAGPVPTAIIGGVAGSILLVLIVVGGIVVALRRRRHTFKGDYSTKKHVYGNGYSKAGIPQHHPPMAQNLQYPDDSDDEKKAGPLGGSSYEEEEEEEEGGGGGERKVGGPHPKYDEDAKRPYFTVDEAEARQDGYGDRTLGYQYDPEQLDLAENMVSQNDGSFISKKEWYV

SEQ ID NO: 58294 - protein, 352 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITAFCQLIYPGKGRTRARMF

SEQ ID NO: 58295 - protein, 458 aa, Homo sapiens
MARMGLAGAAGRWWGLALGLTAFFLPGVHSQVVQVNDSMYGFIGTDVVLHCSFANPLPSVKITQVTWQKSTNGSKQNVAIYNPSMGVSVLAPYRERVEFLRPSFTDGTIRLSRLELEDEGVYICEFATFPTGNRESQLNLTVMAKPTNWIEGTQAVLRAKKGQDDKVLVATCTSANGKPPSVVSWETRLKGEAEYQEIRNPNGTVTVISRYRLVPSREAHQQSLACIVNYHMDRFKESLTLNVQYEPEVTIEGFDGNWYLQRMDVKLTCKADANPPATEYHWTTLNGSLPKGVEAQNRTLFFKGPINYSLAGTYICEATNPIGTRSGQVEVNITEKPRPQRGLGSAARLLAGTVAVFLILVAVLTVFFLYNRQQKSPPETDGAGTDQPLSQKPEPSPSRQSSLVPEDIQVVHLDPGRQQQQEEEDLQKLSLQPPYYDLGVSPSYHPSVRTTEPRGECP

SEQ ID NO: 58296 - protein, 538 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPNTAGAGATGGIIGGIIAAIIATAVAATGILICRQQRKEQTLQGAEEDEDLEGPPSYKPPTPKAKLEAQEMPSQLFTLGASEHSPLKTPYFDAGASCTEQEMPRYHELPTLEERSGPLHPGATSLGSPIPVPPGPPAVEDVSLDLEDEEGEEEEEYLDKINPIYDALSYSSPSDSYQGKGFVMSRAMYV

SEQ ID NO: 58297 - protein, 479 aa, Homo sapiens
MARAAALLPSRSPPTPLLWPLLLLLLLETGAQDVRVQVLPEVRGQLGGTVELPCHLLPPVPGLYISLVTWQRPDAPANHQNVAAFHPKMGPSFPSPKPGSERLSFVSAKQSTGQDTEAELQDATLALHGLTVEDEGNYTCEFATFPKGSVRGMTWLRVIAKPKNQAEAQKVTFSQDPTTVALCISKEGRPPARISWLSSLDWEAKETQVSGTLAGTVTVTSRFTLVPSGRADGVTVTCKVEHESFEEPALIPVTLSVRYPPEVSISGYDDNWYLGRTDATLSCDVRSNPEPTGYDWSTTSGTFPTSAVAQGSQLVIHAVDSLFNTTFVCTVTNAVGMGRAEQVIFVRETPRASPRDVGPLVWGAVGGTLLVLLLLAGGSLAFILLRVRRRRKSPGGAGGGASGDGGFYDPKAQVLGNGDPVFWTPVVPGPMEPDGKDEEEEEEEEKAEKGLMLPPPPALEDDMESQLDGSLISRRAVYV

SEQ ID NO: 58298 - protein, 366 aa, Homo sapiens
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISAYNSVASLNC

SEQ ID NO: 58299 - protein, 549 aa, Homo sapiens
MARTLRPSPLCPGGGKAQLSSASLLGAGLLLQPPTPPPLLLLLFPLLLFSRLCGALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDPPTTTTLQPTIQWHPSTADIEDLATEPKKLPFPLSTLATIKDDTIATIIASVVGGALFIVLVSVLAGIFCYRRRRTFRGDYFAKNYIPPSDMQKESQIDVLQQDELDSYPDSVKKENKNPVNNLIRKDYLEEPEKTQWNNVENLNRFERPMDYYEDLKMGMKFVSDEHYDENEDDLVSHVDGSVISRREWYV

SEQ ID NO: 58300 - protein, 487 aa, Homo sapiens
MAEGWRWCFVRRTPGLLRGPLLPRSFSGNPRALAGPIIVEPHVTAVWGKNVSLKCLIEVNETITQISWEKIHGKSSQTVAVHHPQYGFSVQGEYQGRVLFKNYSLNDATITLHNIGFSDSGKYICKAVTFPLGNAQSSTTVTVLVEPTVSLIKGPDSLIDGGNETVAAICIAATGKPVAHIDWEGDLGEMESTTTSFPNETATIISQYKLFPTRFARGRRITCVVKHPALEKDIRYSFILDIQYAPEVSVTGYDGNWFVGRKGVNLKCNADANPPPFKSVWSRLDGQWPDGLLASDNTLHFVHPLTFNYSGVYICKVTNSLGQRSDQKVIYISDVPFKQTSSIAVAGAVIGAVLALFIIAIFVTVLLTPRKKRPSYLDKVIDLPPTHKPPPLYEERSPPLPQKDLFQPEHLPLQTQFKEREVGNLQHSNGLNSRSFDYEDENPVGEDGIQQMYPLYNQMCYQDRSPGKHHQNNDPKRVYIDPREHYV

SEQ ID NO: 58301 - protein, 510 aa, Homo sapiens
MPLSLGAEMWGPEAWLLLLLLLASFTGRCPAGELETSDVVTVVLGQDAKLPCFYRGDSGEQVGQVAWARVDAGEGAQELALLHSKYGLHVSPAYEGRVEQPPPPRNPLDGSVLLRNAVQADEGEYECRVSTFPAGSFQARLRLRVLVPPLPSLNPGPALEEGQGLTLAASCTAEGSPAPSVTWDTEVKGTTSSRSFKHSRSAAVTSEFHLVPSRSMNGQPLTCVVSHPGLLQDQRITHILHVSFLAEASVRGLEDQNLWHIGREGAMLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQPEESVGLRAEGHPDSLKDNSSCSVMSEEPEGRSYSTLTTVREIETQTELLSPGSGRAEEEEDQDEGIKQAMNHFVQENGTLRAKPTGNGIYINGRGHLV

SEQ ID NO: 58302 - protein, 219 aa, Homo sapiens
MLKCLSEGQPPPSYNWTRLDGPLPSGVRVDGDTLGFPPLTTEHSGIYVCHVSNEFSSRDSQVTVDVLDPQEDSGKQVDLVSASVVVVGVIAALLFCLLVVVVVLMSRYHRRKAQQMTQKYEEELTLTRENSIRRLHSHHTDPRSQSEEPEGRSYSTLTTVREIETQTELLSPGSGRAEEEEDQDEGIKQAMNHFVQENGTLRAKPTGNGIYINGRGHLV

SEQ ID NO: 58303 - protein, 685 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKKAAAALFGGKKDKARYIDTHNRVSKEDEDIYKLRHDLKKTSITQQPSKHRTDEELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKTVHYYAELGQCSVFPATDAPEQFISQVTVLKYFSHYMEENLMDGGDLPSVTDIRRPRLYLLQWLKSDKALMMLFNDGTFQVNFYHDHTKIIICSQNEEYLLTYINEDRISTTFRLTTLLMSGCSSELKNRMEYALNMLLQRCN

SEQ ID NO: 58304 - protein, 387 aa, Homo sapiens
MELLRTITYQPAASTKMCEQALGKGCGADSKKKRPPQPPEESQPPQSQAQVPPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFCRASLRTDCLLAVVIQFQISTYQAQLRISLRKQLLLFLVAKKTKQDILTHIIECLKKMKTSTSLGMI

SEQ ID NO: 58305 - protein, 379 aa, Homo sapiens
MELLRTITYQPAASTKMCEQALGKGCGADSKKKRPPQPPEESQPPQSQAQVPPAAPHHHHHHSHSGPEISRIIVDPTTGKRYCRGKVLGKGGFAKCYEMTDLTNNKVYAAKIIPHSRVAKPHQREKIDKEIELHRILHHKHVVQFYHYFEDKENIYILLEYCSRRSMAHILKARKVLTEPEVRYYLRQIVSGLKYLHEQEILHRDLKLGNFFINEAMELKVGDFGLAARLEPLEHRRRTICGTPNYLSPEVLNKQGHGCESDIWALGCVMYTMLLGRPPFETTNLKETYRCIREARYTMPSSLLAPAKHLIASMLSKNPEDRPSLDDIIRHDFFLQGFTPDRLSSSCCHTVPDFHLSSPAKNFFKRAAEHIISVGHQMG

SEQ ID NO: 58306 - protein, 491 aa, Homo sapiens
VDLLRAGEVPKPFPTHYKDLWDNKHVKMPCSEQNLYPVEDENGERTAGSRWELIQTALLNKFTRPQNLKDAILKYNVAYSKKWDFTALIDFWDKVLEEAEAQHLYQSILPDMVKIALCLPNICTQPIPLLKQKMNHSITMSQEQIASLLANAFFCTFPRRNAKMKSEYSSYPDINFNRLFEGRSSRKPEKLKTLFCYFRRVTEKKPTGLVTFTRQSLEDFPEWERCEKPLTRLHVTYEGTIEENGQGMLQVDFANRFVGGGVTSAGLVQEEIRFLINPELIISRLFTEVLDHNECLIITGTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 58307 - protein, 192 aa, Homo sapiens
  MOD_RES (1)..(1): Any amino acid
XTEQYSEYTGYAETYRWSRSHEDGSERDDWQRRCTEIVAIDALHFRRYLDQFVPEKMRRELNKAYCGFLRPGVSSENLSAVATGNWGCGAFGGDARLKALIQILAAAAAERDVVYFTFGDSELMRDIYSMHIFLTERKLTVGDVYKLLLRYYNEECRNCSTPGPDIKLYPFIYHAVESCAETADHSGQRTGT

SEQ ID NO: 58308 - protein, 155 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGVYILGQHGHSAPTLKLPGGPRLREQSKPPPACPLPHVQIKRMVPMLFQQHLLDSASSVA

SEQ ID NO: 58309 - protein, 108 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTEPPIPCGIEVMGR

SEQ ID NO: 58310 - protein, 108 aa, Homo sapiens; identical to SEQ ID NO: 58309

SEQ ID NO: 58311 - protein, 1014 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKVCSTNDLKELLIFNKQQVPSGESAILDRVADGMVFGALLPCEECSGQLVFKSDAYYCTGDVTAWTKCMVKTQTPNRKEWVTPKEFREISYLKKLKVKKQDRIFPPETSASVAATPPPSTASAPAAVNSSASADKPLSNMKILTLGKLSRNKDEVKAMIEKLGGKLTGTANKASLCISTKKEVEKMNKKMEEVKEANIRVVSEDFLQDVSASTKSLQELFLAHILSPWGAEVKAEPVEVVAPRGKSGAALSKKSKGQVKEEGINKSEKRMKLTLKGGAAVDPDSGLEHSAHVLEKGGKVFSATLGLVDIVKGTNSYYKLQLLEDDKENRYWIFRSWGRVGTVIGSNKLEQMPSKEDAIEHFMKLYEEKTGNAWHSKNFTKYPKKFYPLEIDYGQDEEAVKKLTVNPGTKSKLPKPVQDLIKMIFDVESMKKAMVEYEIDLQKMPLGKLSKRQIQAAYSILSEVQQAVSQGSSDSQILDLSNRFYTLIPHDFGMKKPPLLNNADSVQAKVEMLDNLLDIEVAYSLLRGGSDDSSKDPIDVNYEKLKTDIKVVDRDSEEAEIIRKYVKNTHATTHNAYDLEVIDIFKIEREGECQRYKPFKQLHNRRLLWHGSRTTNFAGILSQGLRIAPPEAPVTGYMFGKGIYFADMVSKSANYCHTSQGDPIGLILLGEVALGNMYELKHASHISKLPKGKHSVKGLGKTTPDPSANISLDGVDVPLGTGISSGVNDTSLLYNEYIVYDIAQVNLKYLLKLKFNFKTSLW

SEQ ID NO: 58312 - protein, 250 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKKKKKKKKKERKKKKKKRKKK

SEQ ID NO: 58313 - protein, 710 aa, Homo sapiens
MDFSMVAGAAAYNEKSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCGRCQCLIIGATLWNLVS

SEQ ID NO: 58314 - protein, 819 aa, Homo sapiens
MDFSMVAGAAAYNEKSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 58315 - protein, 701 aa, Homo sapiens
MAQAGVVGEVTQVLCAAGGALELPELRRRLRMGLSADALERLLRQRGRFVVAVRAGGAAAAPERVVLAASPLRLCRAHQGSKPGCVGLCAQLHLCRFMVYGACKFLRAGKNCRNSHSLTTEHNLSVLRTHGVDHLSYNELCQLLFQNDPWLLPEICQHYNKGDGPHGSCAFQKQCIKLHICQYFLQGECKFGTSCKRSHDFSNSENLEKLEKLGMSSDLVSRLPTIYRNAHDIKNKSSAPSRVPPLFVPQGTSERKDSSGSVSPNTLSQEEGDQICLYHIRKSCSFQDKCHRVHFHLPYRWQFLDRGKWEDLDNMELIEEAYCNPKIERILCSESASTFHSHCLNFNAMTYGATQARRLSTASSVTKPPHFILTTDWIWYWSDEFGSWQEYGRQGTVHPVTTVSSSDVEKAYLAYCTPGSDGQAATLKFQAGKHNYELDFKAFVQKNLVYGTTKKVCRRPKYVSPQDVTTMQTCNTKFPGPKSIPDYWDSSALPDPGFQKITLSSSSEEYQKVWNLFNRTLPFYFVQKIERVQNLALWEVYQWQKGQMQKQNGGKAVDERQLFHGTSAIFVDAICQQNFDWRVCGVHGTSYGKGSYFARDAAYSHHYSKSDTQTHTMFLARVLVGEFVRGNASFVRPPAKEGWSNAFYDSCVNSVSDPSIFVIFEKHQVYPEYVIQYTTSSKPSVTPSILLALGSLFSSRQ

SEQ ID NO: 58316 - protein, 130 aa, Homo sapiens
MFLARVLVGEFVRGNASFVRPPAKEGWSNAFYDSCVNSVSDPSIFVIFEKTRSTQSMSSSTPPPPSPRSHPPSCWPWAPCSAADSERTGVFQAFHLLCLEMAIWAFPFLFKQKLLMNCSLNIDLSMKLCS

SEQ ID NO: 58317 - protein, 282 aa, Homo sapiens
MSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKVNVMIRACSPSYWEAEVEGLHEPRSLTPVWVT

SEQ ID NO: 58318 - protein, 797 aa, Homo sapiens
MYLRRLLRPLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 58319 - protein, 1720 aa, Homo sapiens
MAVPGSFPLLVEGSWGPDPPKNLNTKLQMYFQSPKRSGGGECEVRQDPRSPSRFLVFFYPEDVRQKVLERKNHELVWQGKGTFKLTVQLPATPDEIDHVFEEELLTKESKTKEDVKEPDTIRFVDDCTKHHSIKQLQLSPRLLEVTNTIRVENLPPGADDYSLKLFFENPYNGGGRVANVEYFPEESSALIEFFDRKVLDTIMATKLDFNKMPLSVFPYYASLGTALYGKEKPLIKLPAPFEESLDLPLWKFLQKKNHLIEEINDEMRRCHCELTWSQLSGKVTIRPAATLVNEGRPRIKTWQADTSTTLSSIRSKYKVNPIKVDPTMWDTIKNDVKDDRILIEFDTLKEMVILAGKSEDVQSIEVQVRELIESTTQKIKREEQSLKEKMIISPGRYFLLCHSSLLDHLLTECPEIEICYDRVTQHLCLKGPSADVYKAKCEIQEKVYTMAQKNIQVSPEIFQFLQQVNWKEFSKCLFIAQKILALYELEGTTVLLTSCSSEALLEAEKQMLSALNYKRIEVENKEVLHGKKWKGLTHNLLKKQNSSPNTVIINELTSETTAEVIITGCVKEVNETYKLLFNFVEQNMKIERLVEVKPSLVIDYLKTEKKLFWPKIKKVNVQVSFNPENKQKGILLTGSKTEVLKAVDIVKQVWDSVCVKSVHTDKPGAKQFFQDKARFYQSEIKRLFGCYIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKVGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 58320 - protein, 1801 aa, Homo sapiens
MAVPGSFPLLVEGSWGPDPPKNLNTKLQMYFQSPKRSGGGECEVRQDPRSPSRFLVFFYPEDVRQKVLERKNHELVWQGKGTFKLTVQLPATPDEIDHVFEEELLTKESKTKEDVKEPDVSEELDTKLPLDGGLDKMEDIPEECENISSLVAFENLKANVTDIMLILLVENISGLSNDDFQVEIIRDFDVAVVTFQKHIDTIRFVDDCTKHHSIKQLQLSPRLLEVTNTIRVENLPPGADDYSLKLFFENPYNGGGRVANVEYFPEESSALIEFFDRKVLDTIMATKLDFNKMPLSVFPYYASLGTALYGKEKPLIKLPAPFEESLDLPLWKFLQKKNHLIEEINDEMRRCHCELTWSQLSGKVTIRPAATLVNEGRPRIKTWQADTSTTLSSIRSKYKVNPIKVDPTMWDTIKNDVKDDRILIEFDTLKEMVILAGKSEDVQSIEVQVRELIESTTQKIKREEQSLKEKMIISPGRYFLLCHSSLLDHLLTECPEIEICYDRVTQHLCLKGPSADVYKAKCEIQEKVYTMAQKNIQVSPEIFQFLQQVNWKEFSKCLFIAQKILALYELEGTTVLLTSCSSEALLEAEKQMLSALNYKRIEVENKEVLHGKKWKGLTHNLLKKQNSSPNTVIINELTSETTAEVIITGCVKEVNETYKLLFNFVEQNMKIERLVEVKPSLVIDYLKTEKKLFWPKIKKVNVQVSFNPENKQKGILLTGSKTEVLKAVDIVKQVWDSVCVKSVHTDKPGAKQFFQDKARFYQSEIKRLFGCYIELQENEVMKEGGSPAGQKCFSRTVLAPGVVLIVQQGDLARLPVDVVVNASNEDLKHYGGLAAALSKAAGPELQADCDQIVKREGRLLPGNATISKAGKLPYHHVIHAVGPRWSGYEAPRCVYLLRRAVQLSLCLAEKYKYRSIAIPAISSGVFGFPLGRCVETIVSAIKENFQFKKDGHCLKEIYLVDVSEKTVEAFAEAVKTVFKATLPDTAAPPGLPPAAAGPGKTSWEKGSLVSPGGLQMLLVKEGVQNAKTDVVVNSVPLDLVLSRGPLSKSLLEKAGPELQEELDTVGQGVAVSMGTVLKTSSWNLDCRYVLHVVAPEWRNGSTSSLKIMEDIIRECMEITESLSLKSIAFPAIGTGNLGFPKNIFAELIISEVFKFSSKNQLKTLQEVHFLLHPSDHENIQAFSDEFARRANGNLVSDKIPKAKDTQGFYGTVSSPDSGVYEMKIGSIIFQVASGDITKEEADVIVNSTSNSFNLKAGVSKAILECAGQNVERECSQQAQQRKNDYIITGGGFLRCKNIIHVIGGNDVKSSVSSVLQECEKKNYSSICLPAIGTGNAKQHPDKVAEAIIDAIEDFVQKGSAQSVKKVKVVIFLPQVLDVFYANMKKREGTQLSSQQSVMSKLASFLGFSKQSPQKKNHLVLEKKTESATFRVCGENVTCVEYAISWLQDLIEKEQCPYTSEDECIKDFDEKEYQELNELQKKLNINISLDHKRPLIKVLGISRDVMQARDEIEAMIKRVRLAKEQESRADCISEFIEWQYNDNNTSHCFNKMTNLKLEDARREKKKTVDVKINHRHYTVNLNTYTATDTKGHSLSVQRLTKSKVDIPAHWSDMKQQNFCVVELLPSDPEYNTVASKFNQTCSHFRIEKIERIQNPDLWNSYQAKKKTMDAKNGQTMNEKQLFHGTDAGSVPHVNRNGFNRSYAGKNAVAYGKGTYFAVNANYSANDTYSRPDANGRKHVYYVRVLTGIYTHGNHSLIVPPSKNPQNPTDLYDTVTDNVHHPSLFVAFYDYQAYPEYLITFRK

SEQ ID NO: 58321 - protein, 194 aa, Homo sapiens
  MOD_RES (1)..(1): Any amino acid
XVRRRAELRMAVPGSFPLLVEGSWGPDPPKNLNTKLQMYFQSPKRSGGGECEVRQDPRSPSRFLVFFYPEDVRQKVLERKNHELVWQGKGTFKLTVQLPATPDEIDHVFEEELLTKESKTKEDVKEPDTIRFVDDCTKHHSIKQLQLSPRLLEVTNTIRVENLPPGADDYSLKLFFENPYNGGGRVANVEYFPE

SEQ ID NO: 58322 - protein, 444 aa, Homo sapiens
MLQRIGLIFLHNIVVVSNCFYFQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 58323 - protein, 678 aa, Homo sapiens
MAAPGPLPAAALSPGAPTPRELMHGVAGVTSRAGRDREAGSVLPAGNRGARKASRRSSSRSMSRDNKFSKKDCLSIRNVVASIQTKEGLNLKLISGDVLYIWADVIVNSVPMNLQLGGGPLSRAFLQKAGPMLQKELDDRRRETEEKVGNIFMTSGCNLDCKAVLHAVAPYWNNGAETSWQIMANIIKKCLTTVEVLSFSSITFPMIGTGSLQFPKAVFAKLILSEVFEYSSSTRPITSPLQEVHFLVYTNDDEGCQAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 58324 - protein, 425 aa, Homo sapiens
MKHTAFLDEFTNWSRINPNKARIPMAGDTQGVVGTVSKPCFTAYEMKIGAITFQVATGDIATEQVDVIVNSTARTFNRKSGVSRAILEGAGQAVESECAVLAAQPHRDFIITPGGCLKCKIIIHVPGGKDVRKTVTSVLEECEQRKYTSVSLPAIGTGNAGKNPITVADNIIDAIVDFSSQHSTPSLKTVKVVIFQPELLNIFYDSMKKRDLSASLNFQSTFSMTTCNLPEHWTDMNHQLFCMVQLEPGQSEYNTIKDKFTRTCSSYAIEKIERIQNAFLWQSYQVKKRQMDIKNDHKNNERLLFHGTDADSVPYVNQHGFNRSCAGKNAVSYGKGTYFAVDASYSAKDTYSKPDSNGRKHMYVVRVLTGVFTKGRAGLVTPPPKNPHNPTDLFDSVTNNTRSPKLFVVFFDNQAYPEYLITFTA

SEQ ID NO: 58325 - protein, 854 aa, Homo sapiens
MDFSMVAGAAAYNEKSGRITSLSLLFQKVFAQIFPQWRKGNTEECLPYKCSETGALGENYSWQIPINHNDFKILKNNERQLCEVLQNKFGCISTLVSPVQEGNSKSLQVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 58326 - protein, 777 aa, Homo sapiens
MSVSCVKSSRISLAVSLPWSLQFRKATANLCVFRKMLTPRIELSVWKDDLTTHAVDAVVNAANEDLLHGGGLALALVKAGGFEIQEESKQFVARYGKVSAGEIAVTGAGRLPCKQIIHAVGPRWMEWDKQGCTGKLQRAIVSILNYVIYKNTHIKTVAIPALSSGIFQFPLNLCTKTIVETIRVSLQGKPMMSNLKEIHLVSNEDPTVAAFKAASEFILGKSELGQETTPSFNAMVVNNLTLQIVQGHIEWQTADVIVNSVNPHDITVGPVAKSILQQAGVEMKSEFLATKAKQFQRSQLVLVTKGFNLFCKYIYHVLWHSEFPKPQILKHAMKECLEKCIEQNITSISFPALGTGNMEIKKETAAEILFDEVLTFAKDHVKHQLTVKFVIFPTDLEIYKAFSSEMAKRSKMLSLNNYSVPQSTREEKRENGLEARSPAINLMGFNVEEMYEAHAWIQRILSLQNHHIIENNHILYLGRKEHDILSQLQKTSSVSITEIISPGRTELEIEGARADLIEVVMNIEDMLCKVQEEMARKKERGLWRSLGQWTIQQQKTQDEMKENIIFLKCPVPPTQELLDQKKQFEKCGLQVLKVEKIDNEVLMAAFQRKKKMMEEKLHRQPVSHRLFQQVPYQFCNVVCRVGFQRMYSTPCDPKYGAGIYFTKNLKNLAEKAKKISAADKLIYVFEAEVLTGFFCQGHPLNIVPPPLSPGAIDGHDSVVDNVSSPETFVIFSGMQAIPQYLWTCTQEYVQSQDYSSGPMRPFAQHPWRGFASGSPVD

SEQ ID NO: 58327 - protein, 819 aa, Homo sapiens; identical to SEQ ID NO: 58314

SEQ ID NO: 58328 - protein, 479 aa, Homo sapiens
MSDGFDRAPGAGRGRSRGLGRGGGGPEGGGFPNGAGPAERARHQPPQPKAPGFLQPPPLRQPRTTPPPGAQCEVPASPQRPSRPGALPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 58329 - protein, 367 aa, Homo sapiens
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 58330 - protein, 400 aa, Homo sapiens
MSDGFDRAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDYQEKYQELLEREDFFPDYEENGTDLSGAGDPYLDDIDDEMDPEIEEAYEKFCLESERKRKQ

SEQ ID NO: 58331 - protein, 168 aa, Homo sapiens
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLN

SEQ ID NO: 58332 - protein, 200 aa, Homo sapiens
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPM

SEQ ID NO: 58333 - protein, 351 aa, Homo sapiens
MSDGFDRAPEQTRPLRAPPSSQDKIPQQNSESAMAKPQVVVAPVLMSKLSVNAPEFYPSGYSSSYTESYEDGCEDYPTLSEYVQDFLNHLTEQPGSFETEIEQFAETLNGCVTTDDALQELVELIYQQATSIPNFSYMGARLCNYLSHHLTISPQSGNFRQLLLQRCRTEYEVKDQAAKGDEVTRKRFHAFVLFLGELYLNLEIKGTNGQVTRADILQVGLRELLNALFSNPMDDNLICAVKLLKLTGSVLEDAWKEKGKMDMEEIIQRIENVVLDANCSRDVKQMLLKLVELRSSNWGRVHATSTYREATPENDPNYFMNEPTFYTSDGVPFTAADPDTWMILMMRWTQR

SEQ ID NO: 58334 - protein, 95 aa, Homo sapiens
MAKPQVVVAPVLMSKLSVNAPEFYPSGYSSSYTESYEDGCEDYPTLSEYVQDFLNHLTEQPGSFETEIEQFAETLNGCVTTDDALQELVELIYQQ

SEQ ID NO: 58335 - protein, 127 aa, Homo sapiens
MKDPSRSSTSPSIINEDVIINGHSHEDDNPFAEYMWMENEEEFNRQIEEELWEEEFIERCFQEMLEEEEEHEWFIPARDLPQTMDQIQDQFNDLVISDGSSLEDLVVKSNLNPNAKEFVPGVKYGNI

SEQ ID NO: 58336 - protein, 127 aa, Homo sapiens; identical to SEQ ID NO: 58335

SEQ ID NO: 58337 - protein, 93 aa, Homo sapiens
MKDPSRSSTSPSIINEDVIINGHSHEDDNPFAEYMWMENEEEFNRQIEEELWEEEFIERCFQEMLEEEEEHEWFIPARDLPQTMDQIQDQFND

SEQ ID NO: 58338 - protein, 127 aa, Homo sapiens; identical to SEQ ID NO: 58335

SEQ ID NO: 58339 - protein, 123 aa, Homo sapiens
MNGSNMANTSPSVKSKEDQGLSGHDEKENPFAEYMWMENEEDFNRQVEEELQEQDFLDRCFQEMLDEEDQDWFIPSRDLPQAMGQLQQQLNGLSVSEGHDSEDILSKSNLNPDAKEFIPGEKY

SEQ ID NO: 58340 - protein, 631 aa, Homo sapiens
MNPSTPSYPTASLYVGDLHPDVTEAMLYEKFSPAGPILSIRICRDLITSGSSNYAYVNFQHTKDAEHALDTMNFDVIKGKPVRIMWSQRDPSLRKSGVGNIFVKNLDKSINNKALYDTVSAFGNILSCNVVCDENGSKGYGFVHFETHEAAERAIKKMNGMLLNGRKVFVGQFKSRKEREAELGARAKEFPNVYIKNFGEDMDDERLKDLFGKFGPALSVKVMTDESGKSKGFGFVSFERHEDAQKAVDEMNGKELNGKQIYVGRAQKKVERQTELKRTFEQMKQDRITRYQVVNLYVKNLDDGIDDERLRKAFSPFGTITSAKVMMEGGRSKGFGFVCFSSPEEATKAVTEMNGRIVATKPLYVALAQRKEERQAYLTNEYMQRMASVRAVPNQRAPPSGYFMTAVPQTQNHAAYYPPSQIARLRPSPRWTAQGARPHPFQNKPSAIRPGAPRVPFSTMRPASSQVPRVMSTQRVANTSTQTVGPRPAAAAAAAATPAVRTVPRYKYAAGVRNPQQHRNAQPQVTMQQLAVHVQGQETLTASRLASAPPQKQKQMLGERLFPLIQAMHPTLAGKITGMLLEIDNSELLYMLESPESLRSKVDEAVAVLQAHQAKEATQKAVNSATGVPTV

SEQ ID NO: 58341 - protein, 631 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 58342 - protein, 644 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 58343 - protein, 660 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCKVVCDENGSKGYAFVHFETQEAADKAIEKMNGMLLNDRKVFVGRFKSRKEREAELGAKAKEFTNVYIKNFGEEVDDESLKELFSQFGKTLSVKVMRDPNGKSKGFGFVSYEKHEDANKAVEEMNGKEISGKIIFVGRAQKKVERQAELKRKFEQLKQERISRYQGVNLYIKNLDDTIDDEKLRKEFSPFGSITSAKVMLEDGRSKGFGFVCFSSPEEATKAVTEMNGRIVGSKPLYVALAQRKEERKAHLTNQYMQRVAGMRALPANAILNQFQPAAGGYFVPAVPQAQGRPPYYTPNQLAQMRPNPRWQQGGRPQGFQGMPSAIRQSGPRPTLRHLAPTGNAPASRGLPTTTQRVGSECPDRLAMDFGGAGAAQQGLTDSCQSGGVPTAVQNLAPRAAVAAAAPRAVAPYKYASSVRSPHPAIQPLQAPQPAVHVQGQEPLTASMLAAAPPQEQKQMLGERLFPLIQTMHSNLAGKITGMLLEIDNSELLHMLESPESLRSKVDEAVAVLQAHHAKKEAAQKVGAVAAATS

SEQ ID NO: 58344 - protein, 129 aa, Homo sapiens
MNAAASSYPMASLYVGDLHSDVTEAMLYEKFSPAGPVLSIRVCRDMITRRSLGYAYVNFQQPADAERALDTMNFDVIKGKPIRIMWSQRDPSLRKSGVGNVFIKNLDKSIDNKALYDTFSAFGNILSCK

SEQ ID NO: 58345 - protein, 68 aa, Homo sapiens
  MOD_RES (1)..(1): Any amino acid
XLIQTMHSNLAGKITGMLLEIDNSELLHMLESPESLRSKVDEAVAVLQAHHAKKEAAQKVGAVAAATS

SEQ ID NO: 58346 - protein, 39 aa, Homo sapiens
MNAAASSYPMASLYVGDLHSDVTEAMLYEKFSPAGPVLS

SEQ ID NO: 58347 - protein, 382 aa, Homo sapiens
MGSGEPNPAGKKKKYLKAALYVGDLDPDVTEDMLYKKFRPAGPLRFTRICRDPVTRSPLGYGYVNFRFPADAEWALNTMNFDLINGKPFRLMWSQPDDRLRKSGVGNIFIKNLDKSIDNRALFYLFSAFGNILSCKVVCDDNGSKGYAYVHFDSLAAANRAIWHMNGVRLNNRQVYVGRFKFPEERAAEVRTRDRATFTNVFVKNIGDDIDDEKLKELFCEYGPTESVKVIRDASGKSKGFGFVRYETHEAAQKAVLDLHGKSIDGKVLYVGRAQKKIERLAELRRRFERLRLKEKSRPPGVPIYIKNLDETINDEKLKEEFSSFGSISRAKVMMEVGQGKGFGVVCFSSFEEATKAVDEMNGRIVGSKPLHVTLGQARRRC

SEQ ID NO: 58348 - protein, 218 aa, Homo sapiens
MNGVRLNNRQVYVGRFKFPEERAAEVRTRDRATFTNVFVKNIGDDIDDEKLKELFCEYGPTESVKVIRDASGKSKGFGFVRYETHEAAQKAVLDLHGKSIDGKVLYVGRAQKKIERLAELRRRFERLRLKEKSRPPGVPIYIKNLDETINDEKLKEEFSSFGSISRAKVMMEVGQGKGFGVVCFSSFEEATKAVDEMNGRIVGSKPLHVTLGQARRRC

SEQ ID NO: 58349 - protein, 350 aa, Homo sapiens
MLYKKFRPAGPLRFTRICRDPVTRSPLGYGYVNFRFPADAEWALNTMNFDLINGKPFRLMWSQPDDRLRKSGVGNIFIKNLDKSIDNRALFYLFSAFGNILSCKVVCDDNGSKGYAYVHFDSLAAANRAIWHMNGVRLNNRQVYVGRFKFPEERAAEVRTRDRATFTNVFVKNIGDDIDDEKLKELFCEYGPTESVKVIRDASGKSKGFGFVRYETHEAAQKAVLDLHGKSIDGKVLYVGRAQKKIERLAELRRRFERLRLKEKSRPPGVPIYIKNLDETINDEKLKEEFSSFGSISRAKVMMEVGQGKGFGVVCFSSFEEATKAVDEMNGRIVGSKPLHVTLGQARRRC

SEQ ID NO: 58350 - protein, 306 aa, Homo sapiens
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRGRARATSWYSPY

SEQ ID NO: 58351 - protein, 296 aa, Homo sapiens
MAAAAAAAAAAGAAGGRGSGPGRRRHLVPGAGGEAGEGAPGGAGDYGNGLESEELEPEELLLEPEPEPEPEEEPPRPRAPPGAPGPGPGSGAPGSQEEEEEPGLVEGDPGDGAIEDPELEAIKARVREMEEEAEKLKELQNEVEKQMNMSPPPGNAGPVIMSIEEKMEADARSIYVGNVDYGATAEELEAHFHGCGSVNRVTILCDKFSGHPKGFAYIEFSDKESVRTSLALDESLFRGRQIKVIPKRTNRPGISTTDRGFPRARYRARTTNYNSSRSRFYSGFNSRPRGRVYRSG

SEQ ID NO: 58352 - protein, 745 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEDETSEDANCLALSGHDKTEAKEQLDTETSTTQSETIQTAASLLASQKTSSTDLSDIPALPANPIPVIKNSIKLRLNR

SEQ ID NO: 58353 - protein, 740 aa, Homo sapiens
MLGRRGSDWAVPAPETMPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWEWPNPVLLKQPEECNLNLPVWDPRVNPSDRYHLMPIITPAYPQQNSTYNVSVSTRMVMVEEFKQGLAITDEILLSKAEWSKLFEAPNFFQKYKHYIVLLASAPTEKQRLEWVGLVESKIRILVGSLEKNEFITLAHVNPQSFPAPKENPDKEEFRTMWVIGLVFKKTENSENLSVDLTYDIQSFTDTVYRQAINSKMFEVDMKIAAMHVKRKQLHQLLPNHVLQKKKKHSTEGVKLTALNDSSLDLSMDSDNSMSVPSPTSATKTSPLNSSGSSQGRNSPAPAVTAASVTNIQATEVSVPQVNSSESSGGTSSESIPQTATQPAISPPPKPTVSRVVSSTRLVNPPPRSSGNAATSGNAATKIPTPIVGVKRTSSPHKEESPKKTKTEEEQLDTETSTTQSETIQTAASLLASQKTSSTDLSDIPALPANPIPVIKNSIKLRLNR

SEQ ID NO: 58354 - protein, 285 aa, Homo sapiens
MPFPVTTQGSQQTQPPQKHYGITSPISLAAPKETDCVLTQKLIETLKPFGVFEEEEELQRRILILGKLNNLVKEWIREISESKNLPQSVIENVGGKIFTFGSYRLGVHTKGADIDALCVAPRHVDRSDFFTSFYDKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKRHNIYSNILGFLGGVSWAMLVARTCQLYPNAIASTLVHKFFLVFSKWYVFRLY

SEQ ID NO: 58355 - protein, 636 aa, Homo sapiens
MPFPVTTQGPPQPAPPPNRYGVSSPISLAVPKETDCLLTQRLIETLRPFGVFEEEEELQRRILVLEKLNNLVKEWIREISESKSLPQSVIENVGGKIFTFGSYRLGVHTKGADIDALCVAPSHVDRSDFFTSFYAKLKLQEEVKDLRAVEEAFVPVIKLCFDGIEIDILFARLALQTIPEDLDLRDDSLLKNLDIRCIRSLNGCRVTDEILHLVPNIDNFRLTLRAIKLWAKCHNIYSNILGFLGGVSWAMLVARTCQLYPNAVASTLVRKFFLVFSEWEWPNPVLLKEPEERNLNLPVWDPRVNPSDRYHLMPIITPAYPQQNSTYNVSISTRMVMIEEFKQGLAITHEILLSKAEWSKLFEAPSFFQKYKHYIVLLASASTEKQHLEWVGLVESKIRILVGSLEKNEFITLAHVNPQSFPAPKENPDMEEFRTMWVIGLGLKKPDNSEILSIDLTYDIQSFTDTVYRQAVNSKMFEMGMKITAMHLRRKELHQLLPHHVLQDKKAHSTEGRRLTDLNDSSFDLSAGCENSMSVPSSTSTMKTGPLISSSQGRNSPALAVMTASVANIQATEFSLQQVNTNESSGVALNESIPHAVSQPAISPSPKAMVARVVSSTCLISHPDLQETQQQTYLIL

SEQ ID NO: 58356 - protein, 578 aa, Homo sapiens
MDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 58357 - protein, 593 aa, Homo sapiens
MEIIRSNFKSNLHKVYQAIEEADFFAIDGEFSGISDGPSVSALTNGFDTPEERSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 58358 - protein, 639 aa, Homo sapiens
MEIIRSNFKSNLHKVYQAIEEADFFAIDGEFSGISDGPSVSALTNGFDTPEERYQKLKKHSMDFLLFQFGLCTFKYDYTDSKYITKSFNFYVFPKPFNRSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKYPKGIHVETLETEKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 58359 - protein, 207 aa, Homo sapiens
MEIIRSNFKSNLHKVYQAIEEADFFAIDGEFSGISDGPSVSALTNGFDTPEERYQKLKKHSMDFLLFQFGLCTFKYDYTDSKSSPDVKFVCQSSSIDFLASQGFDFNKVFRNGIPYLNQEEERQLREQYDEKRSQANGAGALSYVSPNTSKCPVTIPEDQKKFIDQVVEKIEDLLQSEENKNLDLEPCTGFQRKLIYQTLSWKRSDI

SEQ ID NO: 58360 - protein, 464 aa, Homo sapiens
MEIIRSNFKSNLHKVYQAIEEADFFAIDGEFSGISDGPSVSALTNGFDTPEERYQKLKKKERYIVISKVDEEERKRREQQKHAKEQEELNDAVGFSRVIHAIANSGKLVIGHNMLLDVMHTVHQFYCPLPADLSEFKEMTTCVFPRLLDTKLMASTQPFKDIINNTSLAELEKRLKETPFNPPKVESAEGFPSYDTASEQLHEAGYDAYITGLCFISMANYLGSFLSPPKIHVSARSKLIEPFFNKLFLMRVMDIPYLNLEGPDLQPKRDHVLHVTFPKEWKTSDLYQLFSAFGNIQISWIDDTSAFVSLSQPEQVKIAVNTSKYAESYRIQTYAEYMGRKQEEKQIKRKWTEDSWKEADSKRLNPQCIPYTLQNHYYRNNSFTAPSTVGKRNLSPSQEEAGLEDGVSGEISDTELEQTDSCAEPLSEGRKKAKKLKRMKKELSPAGSISKNSPATLFEVPDTW

SEQ ID NO: 58361 - protein, 356 aa, Homo sapiens
MDAGVTESGLNVTLTIRLLMHGKEVGSIIGKKGESVKRIREESGARINISEGNCPERIITLTGPTNAIFKAFAMIIDKLEEDINSSMTNSTAASRPPVTLRLVVPATQCGSLIGKGGCKIKEIRESTGAQVQVAGDMLPNSTERAITIAGVPQSVTECVKQICLVMLETLSQSPQGRVMTIPYQPMPASSPVICAGGQDRCSDAAGYPHATHDLEGPPLDAYSIQGQHTISPLDLAKLNQVARQQSHFAMMHGGTGFAGIDSSSPEVKGYWASLDASTQTTHELTIPNNLIGCIIGRQGANINEIRQMSGAQIKIANPVEGSSGRQVTITGSAASISLAQYLINARLSSEKGMGCS

SEQ ID NO: 58362 - protein, 318 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQAYTIQGQYAIPQPDLTKLHQLAMQQSHFPMTHGNTGFSAGLDASAQTTSHELTIPNDLIGCIIGRQGAKINEIRQMSGAQIKIANPVEGSTDRQVTITGSAASISLAQYLINVRLSSETGGMGSS

SEQ ID NO: 58363 - protein, 365 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWGLDASAQTTSHELTIPNDLIGCIIGRQGAKINEIRQMSGAQIKIANPVEGSTDRQVTITGSAASISLAQYLINVRLSSETGGMGSS

SEQ ID NO: 58364 - protein, 335 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 58365 - protein, 301 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGMDTSVFISVRCSARERPVPRSQLDICLKQTSLSSILLV

SEQ ID NO: 58366 - protein, 362 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 58367 - protein, 331 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 58368 - protein, 366 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLETLSQSPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWAGLDASAQTTSHELTIPNDLIGCIIGRQGAKINEIRQMSGAQIKIANPVEGSTDRQVTITGSAASISLAQYLINVRLSSETGGMGSS

SEQ ID NO: 58369 - protein, 361 aa, Homo sapiens
MDTGVIEGGLNVTLTIRLLMHGKEVGSIIGKKGESVKKMREESGARINISEGNCPERIITLAGPTNAIFKAFAMIIDKLEEDISSSMTNSTAASRPPVTLRLVVPASQCGSLIGKGGCKIKEIRESTGAQVQVAGDMLPNSTERAITIAGIPQSIIECVKQICVVMLESPPKGVTIPYRPKPSSSPVIFAGGQDRYSTGSDSASFPHTTPSMCLNPDLEGPPLEAYTIQGQYAIPQPDLTKLHQLAMQQSHFPMTHGNTGFSGIESSSPEVKGYWGLDASAQTTSHELTIPNDLIGCIIGRQGAKINEIRQMSGAQIKIANPVEGSTDRQVTITGSAASISLAQYLINVRLSSETGGMGSS

SEQ ID NO: 58370 - protein, 351 aa, Homo sapiens
LSPGDAFWAPSVLPHSTLSTLSHHPQPQFGRRMESKVSEGGLNVTLTIRLLMHGKVRGAAIVSKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGLDASPPASTHELTIPNDLIGCIIGRQGTKINEIRQMSGAQIKIANATEGSSERQITITGTPANISLAQYLINARLTSEVTGMGTL

SEQ ID NO: 58371 - protein, 322 aa, Homo sapiens
PQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLEAYTIQGQYAIPHPDQLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 58372 - protein, 345 aa, Homo sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLEAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 58373 - protein, 370 aa, Homo sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 58374 - protein, 351 aa, Homo sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGLDASPPASTHELTIPNDLIGCIIGRQGTKINEIRQMSGAQIKIANATEGSSERQITITGTPANISLAQYLINARLTSEVTGMGTL

SEQ ID NO: 58375 - protein, 371 aa, Homo sapiens
MGEGDAFWAPSVLPHSTLSTLSHHPQPQFGRRMESKVSEGGLNVTLTIRLLMHGKEVGSIIGKKGETVKKMREESGARINISEGNCPERIVTITGPTDAIFKAFAMIAYKFEEDIINSMSNSPATSKPPVTLRLVVPASQCGSLIGKGGSKIKEIRESTGAQVQVAGDMLPNSTERAVTISGTPDAIIQCVKQICVVMLESPPKGATIPYRPKPASTPVIFAGGQAYTIQGQYAIPHPDQLTKLHQLAMQQTPFPPLGQTNPAFPGEKLPLHSSEEAQNLMGQSSGLDASPPASTHELTIPNDLIGCIIGRQGTKINEIRQMSGAQIKIANATEGSSERQITITGTPANISLAQYLINARLTSEVTGMGTL

SEQ ID NO: 58376 - protein, 371 aa, Homo sapiens; identical to SEQ ID NO: 58375

SEQ ID NO: 58377 - protein, 5 aa, Homo sapiens
MESKV

SEQ ID NO: 58378 - protein, 1689 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEERAAKVAEQQERERAAQQQQPSASPRAGTPVGALMGVVPPPTPMGMLNQQLTPVAGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 58379 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 58380 - protein, 1602 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMSNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 58381 - protein, 1582 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSESTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 58382 - protein, 1634 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDLKTIAQRIQNGSYKSIHAMAKDIDLLAKNAKTYNEPGSQVFKDANSIKKIFYMKKAEIEHHEMAKSSLRMRTPSNLAAARLTGPSHSKGSLGEERNPTSKYYRNKRAVQGGRLSAITMALQYGSESEEDAALAAARYEEGESEAESITSFMDVSNPFYQLYDTVRSCRNNQGQLIAEPFYHLPSKKKYPDYYQQIKMPISLQQIRTKLKNQEYETLDHLECDLNLMFENAKRYNVPNSAIYKRVLKLQQVMQAKKKELARRDDIEDGDSMISSATSDTGSAKRKSKKNIRKQRMKILFNVVLEAREPGSGRRLCDLFMVKPSKKDYPDYYKIILEPMDLKIIEHNIRNDKYAGEEGMIEDMKLMFRNARHYNEEGSQVYNDAHILEKLLKEKRKELGPLPDDDDMASPKLKLSRKSGISPKKSKYMTPMQQKLNEVYEAVKNYTDKRGRRLSAIFLRLPSRSELPDYYLTIKKPMDMEKIRSHMMANKYQDIDSMVEDFVMMFNNACTYNEPESLIYKDALVLHKVLLETRRDLEGDEDSHVPNVTLLIQELIHNLFVSVMSHQDDEGRCYSDSLAEIPAVDPNFPNKPPLTFDIIRKNVENNRYRRLDLFQEHMFEVLERARRMNRTDSEIYEDAVELQQFFIKIRDELCKNGEILLSPALSYTTKHLHNDVEKERKEKLPKEIEEDKLKREEEKREAEKSEDSSGAAGLSGLHRTYSQDCSFKNSMYHVGDYVYVEPAEANLQPHIVCIERLWEDSAGEKWLYGCWFYRPNETFHLATRKFLEKEVFKSDYYNKVPVSKILGKCVVMFVKEYFKLCPENFRDEDVFVCESRYSAKTKSFKKIKLWTMPISSVRFVPRDVPLPVVRVASVFANADKGDDEKNTDNSEDSRAEDNFNLEKEKEDVPVEMSNGEPGCHYFEQLHYNDMWLKVGDCVFIKSHGLVRPRVGRIEKVWVRDGAAYFYGPIFIHPEETEHEPTKMFYKKEVFLSNLEETCPMTCILGKCAVLSFKDFLSCRPTEIPENDILLCESRYNESDKQMKKFKGLKRFSLSAKVVDDEIYYFRKPIVPQKEPSPLLEKKIQLLEAKFAELEGGDDDIEEMGEEDSEVIEPPSLPQLQTPLASELDLMPYTPPQSTPKSAKGSAKKEGSKRKINMSGYILFSSEMRAVIKAQHPDYSFGELSRLVGTEWRNLETAKKAEYEGMMGGYPPGLPPLQGPVDGLVSMGSMQPLHPGGPPPHHLPPGVPGLPGIPPPGVMNQGVAPMVGTPAPGGSPYGQQVGVLGPPGQQAPPPYPGPHPAGPPVIQQPTTPMFVAPPPKTQRLLHSEAYLKYIEGLSAESNSISKWDQTLAARRRDVHLSKEQESRLPSHWLKSKGAHTTMADALWRLRDLMLRDTLNIRQAYNLENV

SEQ ID NO: 58383 - protein, 152 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFV

SEQ ID NO: 58384 - protein, 26 aa, Homo sapiens
MGSKRRRATSPSSSVSGDFDDGHHSV

SEQ ID NO: 58385 - protein, 230 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQLLFNNAKSYYKPDSPEYKAACKLWDLYLRTRNEFVQKGEADDEDDDEDGQDNQGTVTEGSSPAYLKEILEQLLEAIVVATNPSGRLISELFQKLPSKVQYPDYYAIIKEPIDL

SEQ ID NO: 58386 - protein, 43 aa, Homo sapiens
MGSKRRRATSPSSSVSGDFDDGHHSVSTPGPSRKRRRLSNLPT

SEQ ID NO: 58387 - protein, 118 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEVVSQPIDLMKIQQKLKMEEYDDVNLLTADFQL

SEQ ID NO: 58388 - protein, 87 aa, Homo sapiens
MGSKRRRATSPSSSVSGDFDDGHHSVSTPGPSRKRRRLSNLPTVDPIAVCHELYNTIRDYKDEQGRLLCELFIRAPKRRNQPDYYEV

SEQ ID NO: 58389 - protein, 43 aa, Homo sapiens; identical to SEQ ID NO: 58386

SEQ ID NO: 58390 - protein, 275 aa, Homo sapiens
MEGVAVVTAGSVGAAKTEGAAALPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNISANEGTGHFKPLEKKFVRVSGEATIGHVEKFLRRKMGLDPACQVDIICGDHLLEQYQTLREIRRAIGDAAMQDGLLVLHYGLVVSPLKIT

SEQ ID NO: 58391 - protein, 350 aa, Homo sapiens
MEGVAVVTAGSVGAAKTEGAAALPPPPPVSPPALTPAPAAGEEGPAPLSETGAPGCSGSRPPELEPERSLGRFRGRFEDEDEELEEEEELEEEEEEEEEDMSHFSLRLEGGRQDSEDEEERLINLSELTPYILCSICKGYLIDATTITECLHTFCKSCIVRHFYYSNRCPKCNIVVHQTQPLYNIRLDRQLQDIVYKLVINLEEREKKQMHDFYKERGLEVPKPAVPQPVPSSKGRSKKVLESVFRIPPELDMSLLLEFIGANEGTGHFKPLEKKFVRVSGEATIGHVEKFLRRKMGLDPACQVDIICGDHLLEQYQTLREIRRAIGDAAMQDGLLVLHYGLVVSPLKIT

SEQ ID NO: 58392 - protein, 3396 aa, Homo sapiens
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAVTTEQALKISE

SEQ ID NO: 58393 - protein, 4074 aa, Homo sapiens
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAGTFREEQKCTYQFLMQGFICKQTDQVVLILDSADAIWAIQKLYPVVSVTSGFVDVFSSVNANIPCSTSGSVSTFYSILPIRQITKVCFMDQTPQVLRFFLLGNKSTSKLLLAVFYHELQSPHVFLGESFIPPTLVQSASLLLNESIGANYFNIMDNLLYVVLQGEEPIEIRSGVSIHLALTVMVSVLEKGWEIVILERLTNFLQIGQNQIRFIHEMPGHEETLKAIADSRAKRKRNCPTVTCTSHYRRVGQRRPLMMEMNSHRASPPMTVETISKVIVIEIGDSPTVRSTGMISSLSSNKLQNLAHRVITAQQTGVLENVLNMTIGALLVTQSKGVIGYGNTSSFKTGNLIYIRPYALSILVQPSDGEVGNELPVQPQLVFLDEQNRRVESLGPPSEPWTISASLEGASDSVLKGCTQAETQDGYVSFYNLAVLISGSNWHFIFTVTSPPGVNFTARSKPFAVLPVTRKEKSTIILAASLSSVASWLALSCLVCCWLKRSKSRKTKPEEIPESQTNNQNIHIHISSKRRESQGPKKEDTVVGEDMRMKVMLGKVNQCPHQLMNGVSRRKVSRHIVREEEAAVPAPGTTGITSHGHICAPGAPAQQVYLQETGNWKEGQEQLLRYQLAGQNQLLLLCPDFRQERQQLPGQSRLSKQSGSLGLSQEKKASCGATEAFCLHSVHPETIQEQL

SEQ ID NO: 58394 - protein, 3396 aa, Homo sapiens
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLYQTHSEILSVFPETGSLGGRTNITITGDFFDNSAQVTIAGIPCDIRHVSPRKIECTTRAPGKDVRLTTPQPGNRGLLFEVGDAVEGLELTEATPGYRWQIVPNASSPFGFWSQEGQPFRARLSGFFVAPETNNYTFWIQADSQASLHFSWSEEPRTKVKVASISVGTADWFDSWEQNRDEGTWQQKTPKLELLGGAMYYLEAEHHGIAPSRGMRIGVQIHNTWLNPDVVTTYLREKHQIRVRAQRLPEVQVLNVSGRGNFFLTWDNVSSQPIPANATAHLIQTTIEELLAVKCKLEPLWSNILLRLGFERGPEVSNSDGDLTSGTEPFCGRFSLRQPRHLVLTPPAAQKGYRLDQYTHLCLAYKGHMNKILKMIVSFTIGFQNMVKNTTCDWSLTRTSPESWQFDCTDLWETCVRCFGDLQPPPANSPVLVHQINLLPLAQETGLFYVDEIIIADTNVTVSQADSGTARPGGNLVESVSVVGSPPVYSVTSWLAGCGTELPLITARSVPTEGTEEGSGLVLVTTQRRQRTSPPLGGHFRIQLPNTVISDVPVQISAHHLHQLLQNNADDFTSRYLNASDFTVKEDLYTCYEHVWTLSWSTQIGDLPNFIRVSDENLTGVNPAAATRVVYDGGVFLGPIFGDMLATANQHTQVVVRVNDVPAHCPGSCSFQYLQGSTPCVHSVWYSIDGDINLMIYITGTGFSGDSQFLQVTVNKTSCKVIFSNQTNVVCQTDLLPVGMHRILMLVRPSGLAISATGEDLFLNVKPRLDMVEPSRAADIGGLWATIRGSSLEGVSLILFGSYSCAINVATSNSSRIQCKVPPRGKDGRIVNVTVIRGDYSAVLPRAFTYVSSLNPVIVTLSRNISNIAGGETLVIGVARLMNYTDLDVEVHVQDALAPVHTQSAWGLEVALPPLPAGLHRISVSINGVSIHSQGVDLHIQYLTEVFSIEPCCGSLLGGTILSISGIGFSRDPALVWVLVGNRSCDIVNLTEASIWCETLPAPQIPDAGAPTVPAAVEVWAGNRFFARGPSPSLVGKGFTFMYEAAATPVVTAMQGEITNSSLSLHVGGSNLSNSVILLGNLNCDVETQSFQGNVSLSGCSIPLHSLEAGIYPLQVRQKQMGFANMSVVLQQFAVMPRIMAIFPSQGSACGGTILTVRGLLLNSRRRSVRVDLSGPFTCVILSLGDHTILCQVSLEGDPLPGASFSLNVTVLVNGLTSECQGNCTLFIREEASPVMDALSTNTSGSLTTVLIRGQRLATTADEPMVFVDDQLPCNVTFFNASHVVCQTRDLAPGPHYLSVFYTRNGYACSGNVSRHFYIMPQVFHYFPKNFSLHGGSLLTIEGTGLRGQNTTSVYIDQQTCLTVNIGAELIRCIVPTGNGSVALEIEVDGLWYHIGVIGYNKAFTPELISISQSDDILTFAVAQISGAANIDIFIGMSPCVGVSGNHTVLQCVVPSLPAGEYHVRGYDCIRGWASSALVFTSRVIITAVTENFGCLGGRLVHVFGAGFSPGNVSAAVCGAPCRVLANATVSAFSCLVLPLDVSLAFLCGLKREEDSCEAARHTYVQCDLTVAMATEQLLESWPYLYICEESSQCLFVPDHWAESMFPSFSGLFISPKLERDEVLIYNSSCNITMETEAEMECETPNQPITVKITEIRKRWGQNTQGNFSLQFCRRWSRTHSWFPERLPQDGDNVTVENGQLLLLDTNTSILNLLHIKGGKLIFMAPGPIELRAHAILVSDGGELRIGSEDKPFQGRAQITLYGSSYSTPFFPYGVKFLAVRNGTLSLHGSLPEVIVTCLRATAHALDTVLALEDAVDWNPGDEVVIISGTGVKGAKPMEEIVTVETVQDTDLYLKSPLRYSHNFTENWVAGEHHILKATVALLSRSITIQGNLTNEREKLLVSCQEANAPEGNLQHCLYSMSEKMLGSRDMGARVIVQSFPEEPSQVQLKGVQFQVLGQAFHKHLSSLTLVGAMRESFIQGCTVRNSFSRGLSMCGTLGLKVDSNVFYNILGHALLVGTCTEMRYISWEAIHGRKDDWSGHGNIIRNNVIIQVSGAEGLSNPEMLTPSGIYICSPTNVIEGNRVCGAGYGYFFHLMTNQTSQAPLLSFTQNIAHSCTRYGLFVYPKFQPPWDNVTGTTLFQSFTVWESAGGAQIFRSSNLRLKNFKVYSCRDFGIDVLESDANTSVTDSLLLGHFAHKGSLCMSSGIKTPKRWELMVSNTTFVNFDLINCVAIRTCSDCSQGQGGFTVKTSQLKFTNSSNLVAFPFPHAAILEDLDGSLSGKNRSHILASMETLSASCLVNSSFGRVVHGSACGGGVLFHRMSIGLANTPEVSYDLTMTDSRNKTTTVNYVRDTLSNPRGWMALLLDQETYSLQSENLWINRSLQYSATFDNFAPGNYLLLVHTDLPPYPDILLRCGSRVGLSFPFLPSPGQNQGCDWFFNSQLRQLTYLVSGEGQVQVILRVKEGMPPTISASTSAPESALKWSLPETWQGVEEGWGGYNNTIPGPGDDVLILPNRTVLVDTDLPFFKGLYVMGTLDFPVDRSNVLSVACMVIAGGELKVGTLENPLEKEQKLLILLRASEGVFCDRMNGIHIDPGTIGVYGKVHLYSAYPKNSWTHLGADIASGNERIIVEDAVDWRPHDKIVLSSSSYEPHEAEVLTVKEVKGHHVRIYERLKHRHIGSVHVTEDGRHIRLAAEVGLLTRNIQIQPDVSCRGRLFVGSFRKSSREEFSGVLQLLNVEIQNFGSPLYSSVEFSNVSAGSWIISSTLHQSCGGGIHAAASHGVLLNDNIVFGTAGHGIDLEGQAYTVTNNLVVLMTQPAWSTIWVAGIKVNQVKDINLHGNVVAGSERLGFHIRGHKCSSCELLWSDNVAHSSLHGLHLYKESGLDNCTRISGFLAFKNFDYGAMLHVENSVEIENITLVDNTIGLLAVVYVFSAPQNSVKKVQIVLRNSVIVATSSSFDCIQDKVKPHSANLTSTDRAPSNPRGGRIGILWPVFTSEPNQWPQEPWHKVRNDHSISGIMKLQDVTFSSFVKSCYSDDLDVCILPNAENSGIMHPITAERTRMLKIKDKNKFYFPSLQPRKDLGKVVCPELDCASPRKYLFKDLDGRALGLPPPVSVFPKTEAEWTASFFNAGTKEQSIEINV

SEQ ID NO: 58395 - protein, 4243 aa, Homo sapiens
MGHLWLLGIWGLCGLLLCAADPSTDGSQIIPKVTEIIPKYGSINGATRLTIRGEGFSQANQFNYGVDNAELGNSVQLISSFQSITCDVEKDASHSTQITCYTRAMPEDSYTVRVSVDGVPVTENNTCKGHINSWECTFNAKSFRTPTIRSITPLSGTPGTLITIQGRIFTDVYGSNIALSSNGKNVRILRVYIGGMPCELLIPQSDNLYGLKLDHPNGDMGSMVCKTTGTFIGHHNVSFILDNDYGRSFPQKMAYFVSSLNKIAMFQTYAEVTMIFPSQGSIRGGTTLTISGRFFDQTDFPVRVLVGGEPCDILNVTENSICCKTPPKPHILKTVYPGGRGLKLEVWNNSRPIRLEEILEYNEKTPGYMGASWVDSASYIWLMEQDTFVARFSGFLVAPDSDVYRFYIKGDDRYAIYFSQTGLPEDKVRIAYHSANANSYFSSPTQRSDDIHLQKGKEYYIEILLQEYRLSAFVDVGLYQYRNVYTEQQTGDAVNEEQVIKSQSTILQEVQVITLENWETTNAINEVQKIKVTSPCVEANSCSLYQYRLIYNMEKTVFLPADASEFILQSALNDLWSIKPDTVQVIRTQNPQSYVYMVTFISTRGDFDLLGYEVVEGNNVTLDITEQTKGKPNLETFTLNWDGIASKPLTLWSSEAEFQGAVEEMVSTKCPPQIANFEEGFVVKYFRDYETDFNLEHINRGQKTAETDAYCGRYSLKNPAVLFDSADVKPNRRPYGDILLFPYNQLCLAYKGFLANYIGLKFQYQDNSKITRSTDTQFTYNFAYGNNWTYTCIDLLDLVRTKYTGTNVSLQRISLHKASESQSFYVDVVYIGHTSTISTLDEMPKRRLPALANKGIFLEHFQVNQTKTNGPTMTNQYSVTMTSYNCSYNIPMMAVSFGQIITHETENEFVYRGNNWPGESKIHIQRIQAASPPLSGSFDIQAYGHILKGLPAAVSAADLQFALQSLEGMGRISVTREGTCAGYAWNIKWRSTCGKQNLLQINDSNIIGEKANMTVTRIKEGGLFRQHVLGDLLRTPSQQPQVEVYVNGIPAKCSGDCGFTWDSNITPLVLAISPSQGSYEEGTILTIVGSGFSPSSAVTVSVGPVGCSLLSVDEKELKCQILNGSAGHAPVAVSMADVGLAQNVGGEEFYFVYQSQISHIWPDSGSIAGGTLLTLSGFGFNENSKVLVGNETCNVIEGDLNRITCRTPKKTEGTVDISVTTNGFQATARDAFSYNCLQTPIITDFSPKVRTILGEVNLTIKGYNFGNELTQNMAVYVGGKTCQILHWNFTDIRCLLPKLSPGKHDIYVEVRNWGFASTRDKLNSSIQYVLEVTSMFPQRGSLFGGTEITIRGFGFSTIPAENTVLLGSIPCNVTSSSENVIKCILHSTGNIFRITNNGKDSVHGLGYAWSPPVLNVSVGDTVAWHWQTHPFLRGIGYRIFSVSSPGSVIYDGKGFTSGRQKSTSGSFSYQFTSPGIHYYSSGYVDEAHSIFLQGVINVLPAETRHIPLHLFVGRSEATYAYGGPENLHLGSSVAGCLATEPLCSLNNTRVKNSKRLLFEVSSCFSPSISNITPSTGTVNELITIIGHGFSNLPWANKVTIGSYPCVVEESSEDSITCHIDPQNSMDVGIRETVTLTVYNLGTAINTLSNEFDRRFVLLPNIDLVLPNAGSTTGMTSVTIKGSGFAVSSAGVKVLMGHFPCKVLSVNYTAIECETSPAAQQLVDVDLLIHGVPAQCQGNCTFSYLESITPYITGVFPNSVIGSVKVLIEGEGLGTVLEDIAVFIGNQQFRAIEVNENNITALVTPLPVGHHSVSVVVGSKGLALGNLTVSSPPVASLSPTSGSIGGGTTLVITGNGFYPGNTTVTIGDEPCQIISINPNEVYCRTPAGTTGMVDVKIFVNTIAYPPLLFTYALEDTPFLRGIIPSRGPPGTEIEITGSNFGFEILEISVMINNIQCNVTMANDSVVQCIVGDHAGGTFPVMMHHKTKGSAMSTVVFEYPLNIQNINPSQGSFGGGQTMTVTGTGFNPQNSIILVCGSECAIDRLRSDYTTLLCEIPSNNGTGAEQACEVSVVNGKDLSQSMTPFTYAVSLTPLITAVSPKRGSTAGGTRLTVVGSGFSENMEDVHITIAEAKCDVEYSNKTHIICMTDAHTLSGWAPVCVHIRGVGMAKLDNADFLYVDAWSSNFSWGGKSPPEEGSLVVITKGQTILLDQSTPILKMLLIQGGTLIFDEADIELQAENILITDGGVLQIGTETSPFQHKAVITLHGHLRSPELPVYGAKTLAVREGILDLHGVPVPVTWTRLAHTAKAGERILILQEAVTWKPGDNIVIASTGHRHSQGENEKMTIASVSADGINITLSNPLNYTHLGITVTLPDGTLFEARAEVGILTRNILIRGSDNVEWNNKIPACPDGFDTGEFATQTCLQGKFGEEIGSDQFGGCVMFHAPVPGANMVTGRIEYVEVFHAGQAFRLGRYPIHWHLLGDLQFKSYVRGCAIHQAYNRAVTIHNTHHLLVERNIIYDIKGGAFFIEDGIEHGNILQYNLAVFVQQSTSLLNDDVTPAAFWVTNPNNTIRHNAVAGGTHFGFWYRMNNHPDGPSYDRNICQKRVPLGEFFNNTVHSQGWFGMWIFEEYFPMQTGSCTSTVPAPAIFNSLTTWNCQKGAEWVNGGALQFHNFVMVNNYEAGIETKRILAPYVGGWGETNGAVIKNAKIVGHLDELGMGSAFCTAKGLVLPFSEGLTVSSVHFMNFDRPNCVALGVTSISGVCNDRCGGWSAKFVDVQYSHTPNKAGFRWEHEMVMIDVDGSLTGHKGHTVIPHSSLLDPSHCTQEAEWSIGFPGSVCDASVSFHRLAFNQPSPVSLLEKDVVLSDSFGTSIIPFQKKRLTHMSGWMALIPNANHINWYFKGVDHITNISYTSTFYGFKEEDYVIISHNFTQNPDMFNIIDMRNGSSNPLNWNTSKNGDWHLEANTSTLYYLVSGRNDLHQSQLISGNLDPDVKDVVINFQAYCCILQDCFPVHPPSRKPIPKKRPATYNLWSNDSFWQSSRENNYTVPHPGANVIIPEGTWIVADIDMPSMERLIIWGVLELEDKYNVGAAESSYREVVLNATYISLQGGRLIGGWEDNPFKGDLKIVLRGNHTTQDWALPEGPNQGAKVLGVFGELDLHGIPHSIYKTKLSETAFAGSKVLSLMDAVDWQEGEEIVITTTSYDFHQTETRSIVKILHDHKILILNDSLSYTHFAEKYHVPGTGESYTLAADVGILSRNIKIVGEDYPGWSEDSFGARVLVGSFTENMMTFKGNARISNVEFYHSGQEGFRDSTDPRYAVTFLNLGQIQEHGSSYIRGCAFHHGFSPAIGVFGTDGLDIDDNIIHFTVGEGIRIWGNANRVRGNLIALSVWPGTYQNRKDLSSTLWHAAIEINRGTNTVLQNNVVAGFGRAGYRIDGEPCPGQFNPVEKWFDNEAHGGLYGIYMNQDGLPGCSLIQGFTIWTCWDYGIYFQTTESVHIYNVTLVDNGMAIFPMIYMPAAISHKISSKNVQIKSSLIVGSSPGFNCSDVLTNDDPNIELTAAHRSPRSPSGGRSGICWPTFASAHNMAPRKPHAGIMSYNAISGLLDISGSTFVGFKNVCSGETNVIFITNPLNEDLQHPIHVKNIKLVDTTEQSKIFIHRPDISKVNPSDCVDMVCDAKRKSFLRDIDGSFLGNAGSVIPQAEYEWDGNSQVGIGDYRIPKAMLTFLNGSRIPVTEKAPHKGIIRDSTCKYLPEWQSYQCFGMEYAMMVIESLDPDTETRRLSPVAIMGNGYVDLINGPQDHGWCAGYTCQRRLSLFHSIVALNKSYEVYFTGTSPQNLRLMLLNVDHNKAVLVGIFFSTLQRLDVYVNNLLVCPKTTIWNAQQKHCELNNHLYKDQFLPNLDSTVLGENYFDGTYQMLYLLVKGTIPVEIHTATVIFVSFQLSVATEDDFYTSHNLVKNLALFLKIPSDKIRISKIRGKSLRRKRSMGFIIEIEIGDPPIQFISNGTTGQMQLSELQEIAGSLGQAVILGNISSILGFNISSMSITNPLPSPSDSGWIKVTAQPVERSAFPVHHVAFVSSLLVITQPVAAQPGQPFPQQPSVKATDSDGNCVSVGITALTLRAILKDSNNNQVNGLSGNTTIPFSSCWANYTDLTPLRTGKNYKIEFILDNVVGVESRTFSLLAESVSSSGSSSSSNSKASTVGTYAQIMTVVISCLVGRMWLLEIFMAAVSTLNITLRSY

SEQ ID NO: 58396 - protein, 2253 aa, Homo sapiens
MRPGPALLLLGVGLSLSVGRLPLPPVPRGAQAAVSGAPGGLLRGAPGLGVRGGRALLSLRPSAVRAGGAVLSGRGSLCFPHGGTGRRWYCLDLRVLLSAQRLPWPAAPALALVDLQLSARGGRLSLTWSVRLPRSPGRLAWAFRLRLLGPGAARPASPAARVSPRSAAPGPRPQQGFVARTECPTDGPARVMLQAVNSSSHRAVESSVSCQINACVIQRVRINTDQKGAPVRLSMQAEATINASVQLDCPAARAIAQYWQVFSVPAVGQAPDWTQPLDLPQLEIRNSPLFIHIPNNSLQWGVYVFNFTVSITTGNPKMPEVKDSDAVYVWIVRSSLQAVMLGDANITANFTEQLILDGSTSSDPDADSPLQGLQFFWYCTTDPRNYGGDRIILGSKEVCHPEQANLKWPWASGPVLTLLPETLKGDHVYFFRMVIRKDSRTAFSDKRVHVLQGPKAIAHITCIENCERNFIVSDRFSLFLNCTNCASRDFYKWSILSSSGGEMLFDWMGETVTGRNGAYLSIKAFAFRHFLEAEFSISLYLACWSGVTSVFRHSFIINHGPQIGECKINPAKGIALITKFVVQCSNFRDKHVPLTYKIIVSDLHSVGEISSVKENTLGTILYLGPQSTVPPSFLPVGMLASQYGLKIYAQVYDSLGAFSQVTLHATAQAPTDKNSSKTVLNQLLSFTVGPSSLLSTLIQKKDFLPAGYLLYIVASVLNNMKTELPLRDDRVNLRKHLIDQSFLLPVSTLVEIGQVVMTITKLTQKPSEFTWDAQKRATMRVWQANQALQEYQQKDKRFRSEQIEIVSTGILMSLSNILKMTSPHQVVKDPFYVIESLSDTILANKVPGNKTTSMRTPNFNMYVKKVEKWGINQLFRNEKHCRNCFYPTLNVSSVPGLSANGPISTMFCDFTNDLFPWLNDQENTSVEVSGFRMTGVADNGSVLEITPDVAEVYLVRKNLTFAAFNLTVGPNSEVDGSLKKTTGGFSFQVDSTVLREVLVHIVTEVMVLFTVLVYTGSQITPTALVATFLVPHDIPPFASQSALFDPACTVKKARVVCLPVSLLQLIAQHSHSPHCTVSIVLQAPRFVMKLNDKLVRISIFSVQCLDMYGIQSEWREGYCILGEKTSWYEVHCICKNVVRARRQLGTIGLTGIHLHTHYVMAKVIVIPNPVDLRLNIIKSLHQNPVTLFTVLFIILLYVGLAFWALYRDEMDQHLRGHVIVLPDNDPYDNLCYLVTIFTGSRWGSGTRANVFVQLRGTVSTSDVHCLSHPHFTTLYRGSINTFLLTTKSDLGDIHSIRVWHNNEGRSPSWYLSRIKVENLFSRHIWLFICQKWLSVDTTLDRTFHVTHPDERLTRKDFFFIDVSSNLRKNHMWFSIFASVVAKTFNRLQRLSCCLAMLLSSLLCNIMFFNLNRQEQTESRERKYMRSMMIGIESVLITIPVQLLITFLFTCSQRKPQADLKEVSPQKHPLMSEASEHWEEYLRKWHAYETAKVHPREVAKPASKGKPRLPKASPKATSKPKHRHRKAQIKTPETLGPNTNSNNNIEDDQDVHSEQHPSQKDLQQLKKKPRIVLPWWCVYVAWFLVFATSSISSFFIVFYGLTYGYDKSIEWLFASFCSFCQSVLLVQPSKIILLSGFRTNKPKYCKNLSWSTKYKYTEIRLDGMRMHPEEMQRIHDQIVRIRGTRMYQPLTEDEIRIFKRKKRIKRRALLFLSYILTHFIFLALLLILIVLLRHTDCFYYNQFIRDRFSMDLATVTKLEDIYRWLNSVLLPLLHNDLNPTFLPESSSKILGLPLMRQVRAKSSEKMCLPAEKFVQNSIRREIHCHPKYGIDPEDTKNYSGFWNEVDKQAIDESTNGFTYKPQGTQWLYYSYGLLHTYGSGGYALYFFPEQQRFNSTLRLKELQESNWLDEKTWAVVLELTTFNPDINLFCSISVIFEVSQLGVVNTSISLHSFSLADFDRKASAEIYLYVAILIFFLAYVVDEGCIIMQERASYVRSVYNLLNFALKCIFTVLIVLFLRKHFLATGIIRFYLSNPEDFIPFHAVSQVDHIMRIILGFLLFLTILKTLRYSRFFYDVRLAQRAIQAALPGICHMAFVVSVYFFVYMAFGYLVFGQHEWNYSNLIHSTQTVFSYCVSAFQNTEFSNNRILGVLFLSSFMLVMICVLINLFQAVILSAYEEMKQPVYEEPSDEVEAMTYLCRKLRTMFSFLTSQSKAKDEPEFFIDMLYGQPEKNSHRYLGLKTRNINGKKMVYLVV

SEQ ID NO: 58397 - protein, 4303 aa, Homo sapiens
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEQAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 58398 - protein, 3637 aa, Homo sapiens
MPPAAPARLALALGLGLWLGALAGGPGRGCGPCEPPCLCGPAPGAACRVNCSGRGLRTLGPALRIPADATALTAMAKADGDVKKYGSKRGALALTHGHSLLRDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEAGMGSVELRRPPAHQVMVFPGLRLSREAFLTTAEFGTQELRRPAQLRLQVYRLLSTAGTPENGSEPESRSPDNRTQLAPACMPGGRWCPGANICLPLDASCHPQACANGCTEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTGPGPGRQRQRLLAHREAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 58399 - protein, 1230 aa, Homo sapiens
MVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKAPPTPPTPLWSSPRPPSVLWSPWTAATLRPGCICSSTIRCWTATTCLRNLSPTWQSTYTRSPGPMSTTARLAGGSAQSHSRVLTTGPTPSSFPRGAETQRGVTI

SEQ ID NO: 58400 - protein, 4302 aa, Homo sapiens
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPPAPTCRGPTLLQHVFPASPGATLVGPHGPLASGQLAAFHIAAPLPVTATRWDFGDGSAEVDAAGPAASHRYVLPGRYHVTAVLALGAGSALLGTDVQVEAAPAALELVCPSSVQSDESLDLSIQNRGGSGLEAAYSIVALGEEPARAVHPLCPSDTEIFPGNGHCYRLVVEKAAWLQAQEQCQAWAGAALAMVDSPAVQRFLVSRVTRSLDVWIGFSTVQGVEVGPAPQGEAFSLESCQNWLPGEPHPATAEHCVRLGPTGWCNTDLCSAPHSYVCELQPGGPVQDAENLLVGAPSGDLQGPLTPLAQQDGLSAPHEPVEVMVFPGLRLSREAFLTTAEFGTQELRRPAQLRLQVYRLLSTAGTPENGSEPESRSPDNRTQLAPACMPGGRWCPGANICLPLDASCHPQACANGCTSGPGLPGAPYALWREFLFSVPAGPPAQYSVTLHGQDVLMLPGDLVGLQHDAGPGALLHCSPAPGHPGPRAPYLSANASSWLPHLPAQLEGTWACPACALRLLAATEQLTVLLGLRPNPGLRLPGRYEVRAEVGNGVSRHNLSCSFDVVSPVAGLRVIYPAPRDGRLYVPTNGSALVLQVDSGANATATARWPGGSVSARFENVCPALVATFVPGCPWETNDTLFSVVALPWLSEGEHVVDVVVENSASRANLSLRVTAEEPICGLRATPSPEARVLQGVLVRYSPVVEAGSDMVFRWTINDKQSLTFQNVVFNVIYQSAAVFKLSLTASNHVSNVTVNYNVTVERMNRMQGLQVSTVPAVLSPNATLALTAGVLVDSAVEVAFLWTFGDGEQALHQFQPPYNESFPVPDPSVAQVLVEHNVMHTYAAPGEYLLTVLASNAFENLTQQVPVSVRASLPSVAVGVSDGVLVAGRPVTFYPHPLPSPGGVLYTWDFGDGSPVLTQSQPAANHTYASRGTYHVRLEVNNTVSGAAAQADVRVFEELRGLSVDMSLAVEQGAPVVVSAAVQTGDNITWTFDMGDGTVLSGPEATVEHVYLRAQNCTVTVGAASPAGHLARSLHVLVFVLEVLRVEPAACIPTQPDARLTAYVTGNPAHYLFDWTFGDGSSNTTVRGCPTVTHNFTRSGTFPLALVLSSRVNRAHYFTSICVEPEVGNVTLQPERQFVQLGDEAWLVACAWPPFPYRYTWDFGTEEAAPTRARGPEVTFIYRDPGSYLVTVTASNNISAANDSALVEVQEPVLVTSIKVNGSLGLELQQPYLFSAVGRGRPASYLWDLGDGGWLEGPEVTHAYNSTGDFTVRVAGWNEVSRSEAWLNVTVKRRVRGLVVNASRTVVPLNGSVSFSTSLEAGSDVRYSWVLCDRCTPIPGGPTISYTFRSVGTFNIIVTAENEVGSAQDSIFVYVLQLIEGLQVVGGGRYFPTNHTVQLQAVVRDGTNVSYSWTAWRDRGPALAGSGKGFSLTVLEAGTYHVQLRATNMLGSAWADCTMDFVEPVGWLMVAASPNPAAVNTSVTLSAELAGGSGVVYTWSLEEGLSWETSEPFTTHSFPTPGLHLVTMTAGNPLGSANATVEVDVQVPVSGLSIRASEPGGSFVAAGSSVPFWGQLATGTNVSWCWAVPGGSSKRGPHVTMVFPDAGTFSIRLNASNAVSWVSATYNLTAEEPIVGLVLWASSKVVAPGQLVHFQILLAAGSAVTFRLQVGGANPEVLPGPRFSHSFPRVGDHVVSVRGKNHVSWAQAQVRIVVLEAVSGLQVPNCCEPGIATGTERNFTARVQRGSRVAYAWYFSLQKVQGDSLVILSGRDVTYTPVAAGLLEIQVRAFNALGSENRTLVLEVQDAVQYVALQSGPCFTNRSAQFEAATSPSPRRVAYHWDFGDGSPGQDTDEPRAEHSYLRPGDYRVQVNASNLVSFFVAQATVTVQVLACREPEVDVVLPLQVLMRRSQRNYLEAHVDLRDCVTYQTEYRWEVYRTASCQRPGRPARVALPGVDVSRPRLVLPRLALPVGHYCFVFVVSFGDTPLTQSIQANVTVAPERLVPIIEGGSYRVWSDTRDLVLDGSESYDPNLEDGDQTPLSFHWACVASTQREAGGCALNFGPRGSSTVTIPRERLAAGVEYTFSLTVWKAGRKEEATNQTVLIRSGRVPIVSLECVSCKAQAVYEVSRSSYVYLEGRCLNCSSGSKRGRWAARTFSNKTLVLDETTTSTGSAGMRLVLRRGVLRDGEGYTFTLTVLGRSGEEEGCASIRLSPNRPPLGGSCRLFPLGAVHALTTKVHFECTGWHDAEDAGAPLVYALLLRRCRQGHCEEFCVYKGSLSSYGAVLPPGFRPHFEVGLAVVVQDQLGAAVVALNRSLAITLPEPNGSATGLTVWLHGLTASVLPGLLRQADPQHVIEYSLALVTVLNEYERALDVAAEPKHERQHRAQIRKNITETLVSLRVHTVDDIQQIAAALAQCMGPSRELVCRSCLKQTLHKLEAMMLILQAETTAGTVTPTAIGDSILNITGDLIHLASSDVRAPQPSELGAESPSRMVASQAYNLTSALMRILMRSRVLNEEPLTLAGEEIVAQGKRSDPRSLLCYGGAPGPGCHFSIPEAFSGALANLSDVVQLIFLVDSNPFPFGYISNYTVSTKVASMAFQTQAGAQIPIERLASERAITVKVPNNSDWAARGHRSSANSANSVVVQPQASVGAVVTLDSSNPAAGLHLQLNYTLLDGHYLSEEPEPYLAVYLHSEPRPNEHNCSASRRIRPESLQGADHRPYTFFISPGSRDPAGSYHLNLSSHFRWSALQVSVGLYTSLCQYFSEEDMVWRTEGLLPLEETSPRQAVCLTRHLTAFGASLFVPPSHVRFVFPEPTADVNYIVMLTCAVCLVTYMVMAAILHKLDQLDASRGRAIPFCGQRGRFKYEILVKTGWGRGSGTTAHVGIMLYGVDSRSGHRHLDGDRAFHRNSLDIFRIATPHSLGSVWKIRVWHDNKGLSPAWFLQHVIVRDLQTARSAFFLVNDWLSVETEANGGLVEKEVLAASDAALLRFRRLLVAELQRGFFDKHIWLSIWDRPPRSRFTRIQRATCCVLLICLFLGANAVWYGAVGDSAYSTGHVSRLSPLSVDTVAVGLVSSVVVYPVYLAILFLFRMSRSKVAGSPSPTPAGQQVLDIDSCLDSSVLDSSFLTFSGLHAEAFVGQMKSDLFLDDSKSLVCWPSGEGTLSWPDLLSDPSIVGSNLRQLARGQAGHGLGPEEDGFSLASPYSPAKSFSASDEDLIQQVLAEGVSSPAPTQDTHMETDLLSSLSSTPGEKTETLALQRLGELGPPSPGLNWEQPQAARLSRTGLVEGLRKRLLPAWCASLAHGLSLLLVAVAVAVSGWVGASFPPGVSVAWLLSSSASFLASFLGWEPLKVLLEALYFSLVAKRLHPDEDDTLVESPAVTPVSARVPRVRPPHGFALFLAKEEARKVKRLHGMLRSLLVYMLFLLVTLLASYGDASCHGHAYRLQSAIKQELHSRAFLAITRSEELWPWMAHVLLPYVHGNQSSPELGPPRLRQVRLQEALYPDPPGPRVHTCSAAGGFSTSDYDVGWESPHNGSGTWAYSAPDLLGAWSWGSCAVYDSGGYVQELGLSLEESRDRLRFLQLHNWLDNRSRAVFLELTRYSPAVGLHAAVTLRLEFPAAGRALAALSVRPFALRRLSAGLSLPLLTSVCLLLFAVHFAVAEARTWHREGRWRVLRLGAWARWLLVALTAATALVRLAQLGAADRQWTRFVRGRPRRFTSFDQVAQLSSAARGLAASLLFLLLVKAAQQLRFVRQWSVFGKTLCRALPELLGVTLGLVVLGVAYAQLAILLVSSCVDSLWSVAQALLVLCPGTGLSTLCPAESWHLSPLLCVGLWALRLWGALRLGAVILRWRYHALRGELYRPAWEPQDYEMVELFLRRLRLWMGLSKVKEFRHKVRFEGMEPLPSRSSRGSKVSPDVPPPSAGSDASHPSTSSSQLDGLSVSLGRLGTRCEPEPSRLQAVFEALLTQFDRLNQATEDVYQLEQQLHSLQGRRSSRAPAGSSRGPSPGLRPALPSRLARASRGVDLATGPSRTPLRAKNKVHPSST

SEQ ID NO: 58401 - protein, 2849 aa, Homo sapiens
MAEEAAQNISDDQERCLQAACCLSFGGELSVSTDKSWGLHLCSCSPPGGGLWVEVYANHVLLMSDGKCGCPWCALNGKAEDRESQSPSSSASRQKNIWKTTSEAALSVVNEKTQAVVNEKTQAPLDCDNSADRIPHKPFIIIARAWSSGGPRFHHRRLCATGTADSTFSALLQLQGTTSAAAPCSLKMEASCCVLRLLCCAEDVATGLLPGTVTMETPTKVARPTQTSSQRVPLWPISHFPTSPRSSHGLPPGIPRTPSFTASQSGSEILYPPTQHPPVAILARNSDNFMNPVLNCSLEVEARAPPNLGFRVHMASGEALCLMMDFGDSSGVEMRLHNMSEAMAVTAYHQYSKGIFFHLLHFQLDMSTYKEAETQNTTLNVYLCQSENSCLEDSDPSNLGYELISAFVTKGVYMLKAVIYNEFHGTEVELGPYYVEIGHEAVSAFMNSSSVHEDEVLVFADSQVNQKSTVVIHHFPSIPSYNVSFISQTQVGDSQAWHSMTVWYKMQSVSVYTNGTVFATDTDITFTAVTKETIPLEFEWYFGEDPPVRTTSRSIKKRLSIPQWYRVMVKASNRMSSVVSEPHVIRVQKKIVANRLTSPSSALVNASVAFECWINFGTDVAYLWDFGDGTVSLGSSSSSHVYSREGEFTVEVLAFNNVSASTLRQQLFIVCEPCQPPLVKNMGPGKVQIWRSQPVRLGVTFEAAVFCDISQGLSYTWNLMDSEGLPVSLPAAVDTHRQTLILPSHTLEYGNYTALAKVQIEGSVVYSNYCVGLEVRAQAPVSVISEGTHLFFSRTTSSPIVLRGTQSFDPDDPGATLRYHWECATAGSPAHPCFDSSTAHQLDAAAPTVSFEAQWLSDSYDQFLVMLRVSSGGRNSSETRVFLSPYPDSAFRFVHISWVSFKDTFVNWNDELSLQAMCEDCSEIPNLSYSWDLFLVNATEKNRIEVPFCRVVGLLGSLGLGAISESSQLNLLPTEPGTADPDATTTPFSREPSPVTLGQPATSAPRGTPTEPMTGVYWIPPAGDSAVLGEAPEEGSLDLEPGPQSKGSLMTGRSERSQPTHSPDPHLSDFEAYYSDIQEAIPSGGRQPAKDTSFPGSGPSLSAEESPGDGDNLVDPSLSAGRAEPVLMIDWPKALLGRAVFQGYSSSGITEQTVTIKPYSLSSGETYVLQVSVASKHGLLGKAQLYLTVNPAPRDMACQVQPHHGLEAHTVFSVFCMSGKPDFHYEFSYQIGNTSKHTLYHGRDTQYYFVLPAGEHLDNYKVMVSTEITDGKGSKVQPCTVVVTVLPRYHGNDCLGEDLYNSSLKNLSTLQLMGSYTEIRNYITVITRILSRLSKEDKTASCNQWSRIQDALISSVCRLAFVDQEEMIGSVLMLRDLVSFSNKLGFMSAVLILKYTRALLAQGQFSGPFVIDKGVRLELIGLISRVWEVSEQENSKEEVYRHEEGITVISDLLLGCLSLNHVSTGQMEFRTLLHYNLQSSVQSLGSVQVHLPGDLAGHSPAGAETQSPCYISQLILFKKNPYPGSQAPGQIGGVVGLNLYTCSSRRPINRQWLRKPVMVEFGEEDGLDNRRNKTTFVLLRDKVNLHQFTELSENPQESLQIEIEFSKPVTRAFPVMLLVRFSEKPTPSDFLVKQIYFWDESIVQIYIPAASQKDASVGYLSLLDADYDRKPPNRYLAKAVNYTVHFQWIRCLFWDKREWKSERFSPQPGTSPEKVNCSYHRLAAFALLRRKLKASFEVSDISKLQSHPENLLPSIFIMGSVILYGFLVAKSRQVDHHEKKKAGYIFLQEASLPGHQLYAVVIDTGFRAPARLTSKVYIVLCGDNGLSETKELSCPEKPLFERNSRHTFILSAPAQLGLLRKIRLWHDSRGPSPGWFISHVMVKELHTGQGWFFPAQCWLSAGRHDGRVERELTCLQGGLGFRKLFYCKFTEYLEDFHVWLSVYSRPSSSRYLHTPRLTVSFSLLCVYACLTALVAAGGQEQPHLDVSPTLGSFRVGLLCTLLASPGAQLLSLLFRLSKEAPGSARVEPHSPLRGGAQTEAPHGPNSWGRIPDAQEPRKQPASAILSGSGRAQRKAASDNGTACPAPKLQVHGADHSRTSLMGKSHCCPPHTQAPSSGLEGLMPQWSRALQPWWSSAVWAICGTASLACSLGTGFLAYRFGQEQCVQWLHLLSLSVVCCIFITQPLMVCLMALGFAWKRRADNHFFTESLCEATRDLDSELAERSWTRLPFSSSCSIPDCAGEVEKVLAARQQARHLRWAHPPSKAQLRGTRQRMRRESRTRAALRDISMDILMLLLLLCVIYGRFSQDEYSLNQAIRKEFTRNARNCLGGLRNIADWWDWSLTTLLDGLYPGGTPSARVPGAQPGALGGKCYLIGSSVIRQLKVFPRHLCKPPRPFSALIEDSIPTCSPEVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLELSVVGVSLTYYAVSGHLVTLAGDVTNQFHRGLCRAFMDLTLMASWNQRARWLRGILLFLFTLKCVYLPGIQNTMASCSSMMRHSLPSIFVAGLVGALMLAALSHLHRFLLSMWVLPPGTFTDAFPGLLFHFPRRSQKDCLLGLSKSDQRAMACYFGILLIVSATLCFGMLRGFLMTLPQKRKSFQSKSFVRLKDVTAYMWEKVLTFLRLETPKLEEAEMVENHNYYLDEFANLLDELLMKINGLSDSLQLPLLEKTSNNTGEARTEESPLVDISSYQAAEPADIKDF

SEQ ID NO: 58402 - protein, 164 aa, Homo sapiens
  MOD_RES (1)..(1): Any amino acid
XVGGPENPYLIDPENQNVTLNGPGGCGTREDCVLSLGRTRTEAHTALSRLRASMWIDRSTRAVSVHFTLYNPPTQLFTSVSLRVEILPTGSLVPSSLVESFSIFRSDSALQYHLMLPQLVFLALSLIHLCVQLYRMMDKGVLSYWRKPRNWLEVASLVSFSFEK

SEQ ID NO: 58403 - protein, 968 aa, Homo sapiens
MVNSSRVQPQQPGDAKRPPAPRAPDPGRLMAGCAAVGASLAAPGGLCEQRGLEIEMQRIRQAAARDPPAGAAASPSPPLSSCSRQAWSRDNPGFEAEEEEEEVEGEEGGMVVEMDVEWRPGSRRSAASSAVSSVGARSRGLGGYHGAGHPSGRRRRREDQGPPCPSPVGGGDPLHRHLPLEGQPPRVAWAERLVRGLRGLWGTRLMEESSTNREKYLKSVLRELVTYLLFLIVLCILTYGMMSSNVYYYTRMMSQLFLDTPVSKTEKTNFKTLSSMEDFWKFTEGSLLDGLYWKMQPSNQTEADNRSFIFYENLLLGVPRIRQLRVRNGSCSIPQDLRDEIKECYDVYSVSSEDRAPFGPRNGTAWIYTSEKDLNGSSHWGIIATYSGAGYYLDLSRTREETAAQVASLKKNVWLDRGTRATFIDFSVYNANINLFCVVRLLVEFPATGGVIPSWQFQPLKLIRYVTTFDFFLAACEIIFCFFIFYYVVEEILEIRIHKLHYFRSFWNCLDVVIVVLSVVAIGINIYRTSNVEVLLQFLEDQNTFPNFEHLAYWQIQFNNIAAVTVFFVWIKLFKFINFNRTMSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 58404 - protein, 386 aa, Homo sapiens
MSQLSTTMSRCAKDLFGFAIMFFIIFLAYAQLAYLVFGTQVDDFSTFQECIFTQFRIILGDINFAEIEEANRVLGPIYFTTFVFFMFFILLNMFLAIINDTYSEVKSDLAQQKAEMELSDLIRKGYHKALVKLKLKKNTVDDISESLRQGGGKLNFDELRQDLKGKGHTDAEIEAIFTKYDQDGDQELTEHEHQQMRDDLEKEREDLDLDHSSLPRPMSSRSFPRSLDDSEEDDDEDSGHSSRRRGSISSGVSYEEFQVLVRRVDRMEHSIGSIVSKIDAVIVKLEIMERAKLKRREVLGRLLDGVAEDERLGRDSEIHREQMERLVREELERWESDDAASQISHGLGTPVGLNGQPRPRSSRPSSSQSTEGMEGAGGNGSSNVHV

SEQ ID NO: 58405 - protein, 386 aa, Homo sapiens; identical to SEQ ID NO: 58404

SEQ ID NO: 58406 - protein, 805 aa, Homo sapiens
MNAVGSPEGQELQKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTAWTYHSQDELGGFSHWGRLTSYSGGGYYLDLPGSRQGSAEALRALQEGLWLDRGTRVVFIDFSVYNANINLFCVLRLVVEFPATGGAIPSWQIRTVKLIRYVSNWDFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVKEQAIWKHPQPAPAVTPDPWGVQGGQESEVPYKREEEALEERRLSRGEIPTLQRS

SEQ ID NO: 58407 - protein, 730 aa, Homo sapiens
MNAVGSPEGQELQKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTALVVEFPATGGAIPSWQIRTVKLIRYVSNWDFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVKEQAIWKHPQPAPAVTPDPWGVQGGQESEVPYKREEEALEERRLSRGEIPTLQRS

SEQ ID NO: 58408 - protein, 775 aa, Homo sapiens
MNAVGSPEGQELQKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTAWTYHSQDELGGFSHWGRLTSYSGGGYYLDLPGSRQGSAEALRALQEGLWLDRGTRVVFIDFSVYNANINLFCVLRLVVEFPARRCHPILANPHSQADPLCQQLFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVKEQAIWKHPQPAPAVTPDPWGPGWAGE

SEQ ID NO: 58409 - protein, 760 aa, Homo sapiens
MNAVGSPEGQELQKLGSGAWDNPAYSGPPSPHGTLRVCTISSTGPLQPQPKKPEDEPQETAYRTQVSSCCLHICQGIRGLWGTTLTENTAENRELYIKTTLRELLVYIVFLVDICLLTYGMTSSSAYYYTKVMSELFLHTPSDTGVSFQAISSMADFWDFAQGPLLDSLYWTKWYNNQSLGHGSHSFIYYENMLLGVPRLRQLKVRNDSCVVHEDFREDILSCYDVYSPDKEEQLPFGPFNGTAWTYHSQDELGGFSHWGRLTSYSGGGYYLDLPGSRQGSAEALRALQEGLWLDRGTRVVFIDFSVYNANINLFCVLRLVVEFPATGGAIPSWQIRTVKLIRYVSNWDFFIVGCEVIFCVFIFYYVVEEILELHIHRLRYLSSIWNILDLVVILLSIVAVGFHIFRTLEVNRLMGKLLQQPNTYADFEFLAFWQTQYNNMNAVNLFFAWIKIFKYISFNKTMTQLSSTLARCAKDILGFAVMFFIVFFAYAQLGYLLFGTQVENFSTFIKCIFTQFRIILGDFDYNAIDNANRILGPAYFVTYVFFVFFVLLNMFLAIINDTYSEVKEELAGQKDELQLSDLLKQGYNKTLLRLRLRKERVSDVQKVLQGGEQEIQFEDFTNTLRELGHAEHEITELTATFTKFDRDGNRILDEKEQEKMRQDLEEERVALNTEIEKLGRSIVSSPQGKSGPEAARAGGWVSGEEFYMLTRRVLQLETVLEGVVSQIDAVGSKLKMLERKGWLAPSPGVRFPIKEKRKP

SEQ ID NO: 58410 - protein, 613 aa, Homo sapiens
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRDGTTTKYKMRFSECLTKRI

SEQ ID NO: 58411 - protein, 590 aa, Homo sapiens
MAEASRWHRGVTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 58412 - protein, 624 aa, Homo sapiens
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 58413 - protein, 602 aa, Homo sapiens
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLLKSTEKYSDFYFLACWHIYYNNIIAITIFFAWIKIFKFISFNKTMSQLSSTLSRCVKDIVGFAIMFFIIFFAYAQLGFLVFGSQVDDFSTFQNSIFAQFRIVLGDFNFAGIQQANPILGPIYFITFIFFVFFVLLNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 58414 - protein, 523 aa, Homo sapiens
MAEASRWHRGGASKHKLHYRKEVEITTTLQELLLYFIFLINLCILTFGMVNPHMYYLNKVMSSLFLDTSVPGEERTNFKSIRSITDFWKFMEGPLLEGLYWDSWYNNQQLYNLKNSSRIYYENILLGVPRVRQLKVRNNTCKVYSSFQSLMSECYGKYTSANEDLSNFGLQINTEWRYSTSNTNSPWHWGFLGVYRNGGYIFTLSKSKSETKNKFIDLRLNSWITRGTRVIFIDFSLYNANVNLFCIIRLVAEFPATGGILTSWQFYSVKLLRYVSYYDYFIASCEITFCIFLFVFTTQEVKKIKEFKSAYFKSIWNWLELLLLLLCFVAVSFNTYYNVQIFLLLGQLLKSTEKYSDFYFLACWHIYYNNIIAITIFFAWIKNMFLAIINDTYSEVKADYSIGRRLDFELGKMIKQSYKNVLEKFRLKKAQKDEDKKTKGSGDLAEQARREGFDENEIQNAEQMKKWKERLEKKYYSMEIQDDYQPVTQEEFRELFLYAVELEKELHYINLKLNQVVRKVSAL

SEQ ID NO: 58415 - protein, 265 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSDAPRGTWSTGLPKRNEAKTGADTTAAGPLFQQRPYPSPGAVLRANAEASRTKQQD

SEQ ID NO: 58416 - protein, 170 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNAAVSRKDEELDPMDPSSYSDAPRGTWSTGLPKRNEAKTGADTTAAGPLFQQRPYPSPGAVLRANAEASRTKQQD

SEQ ID NO: 58417 - protein, 67 aa, Homo sapiens
MPLPVALQTRLAKRGILKHLEPEPEEEIIAEDYDDDPVDYEATRLEGLPPSWYKVFDPSCPGWSAMV

SEQ ID NO: 58418 - protein, 265 aa, Homo sapiens; identical to SEQ ID NO: 58415

SEQ ID NO: 58419 - protein, 170 aa, Homo sapiens; identical to SEQ ID NO: 58416

SEQ ID NO: 58420 - protein, 265 aa, Homo sapiens; identical to SEQ ID NO: 58415

SEQ ID NO: 58421 - protein, 213 aa, Homo sapiens
MPLPVALQTRLAKRGILKHLEPEPEEEIIAEDYDDDPVDYEATRLEGLPPSWYKVFDPSCGLPYYWNADTDLVSWLSPHDPNSVVTKSAKKLRSSNADAEEKLDRSHDKSDRGHDKSDRSHEKLDRGHDKSDRGHDKSDRDRERGYDKVDRERERDRERDRDRGYDKADREEGKERRHHRREELAPYPKSKKAVSRKDEELDPMDPSSYSDAP

SEQ ID NO: 58422 - protein, 265 aa, Homo sapiens; identical to SEQ ID NO: 58415

SEQ ID NO: 58423 - protein, 150 aa, Homo sapiens
  MOD_RES (1)..(1): Any amino acid
XIATYLLHLLVQPEEEIIAEDYDDDPVDYEATRLEGLPPSWYKVFDPSCGLPYYWNADTDLVSWLSPHDPNSVVTKSAKKLRSSNAAVSRKDEELDPMDPSSYSDAPRGTWSTGLPKRNEAKTGADTTAAGPLFQQRPYPSPGAVLRANA

SEQ ID NO: 58424 - protein, 740 aa, Homo sapiens
MEKLGVEPEEEGGGDDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQSINLLDVLHIRLLVGSQIAAEMREAMYNQLGLTGCAGVASNKLLAKLVSGVFKPNQQTVLLPESCQHLIHSLNHIKEIPGIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRAGSDFHIGHK

SEQ ID NO: 58425 - protein, 661 aa, Homo sapiens
MEKLGVEPEEEGGGDDDEEDAEAWAMELADVGAAASSQGVHDQVLPTPNASSRVIVHVDLDCFYAQVEMISNPELKDKPLGVQQKYLVVTCNYEARKLGVKKLMNVRDAKEKCPQLVLVNGEDLTRYREMSYKVTELLEEFSPVVERLGFDENFVDLTEMVEKRLQQLQSDELSAVTVSGHVYNNQCIGYKTAKCLEALGINSVRDLQTFSPKILEKELGISVAQRIQKLSFGEDNSPVILSGPPQSFSEEDSFKKCSSEVEAKNKIEELLASLLNRVCQDGRKPHTVRLIIRRYSSEKHYGRESRQCPIPSHVIQKLGTGNYDVMTPMVDILMKLFRNMVNVKMPFHLTLLSVCFCNLKALNTAKKGLIDYYLMPSLSTTSRSGKHSFKMKDTHMEDFPKDKETNRDFLPSGRIESTRTRESPLDTTNFSKEKDINEFPLCSLPEGVDQEVFKQLPVDIQEEILSGKSREKFQGKGSVSCPLHASRGVLSFFSKKQMQDIPINPRDHLSSSKQVSSVSPCEPGTSGFNSSSSSYMSSQKDYSYYLDNRLKDERISQGPKEPQGFHFTNSNPAVSAFHSFPNLQSEQLFSRNHTTDSHKQTVATDSHEGLTENREPDSVDEKITFPSDIDPQVFYELPEAVQKELLAEWKRAGSDFHIGHK

SEQ ID NO: 58426 - protein, 740 aa, Homo sapiens; identical to SEQ ID NO: 58424

SEQ ID NO: 58427 - protein, 870 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 58428 - protein, 672 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 58429 - protein, 780 aa, Homo sapiens
MELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKGRTVTIKLKNVNFEVKTRASTVSSVVSTAEEIFAIAKELLKTEIDADFPHPLRLRLMGVRISSFPNEEDRKHQQRSIIGFLQAGNQALSATECTLEKTDKDKFVKPLEMSHKKSFFDKKRSERKWSHQDTFKCEAVNKQSFQTSQPFQVLKKKMNENLEISENSDDCQILTCPVCFRAQGCISLEALNKHVDECLDGPSISENFKMFSCSHVSATKVNKKENVPASSLCEKQDYEAHPKIKEISSVDCIALVDTIDNSSKAESIDALSNKHSKEECSSLPSKSFNIEHCHQNSSSTVSLENEDVGSFRQEYRQPYLCEVKTGQALVCPVCNVEQKTSDLTLFNVHVDVCLNKSFIQELRKDKFNPVNQPKESSRSTGSSSGVQKAVTRTKRPGLMTKYSTSKKIKPNNPKHTLDIFFK

SEQ ID NO: 58430 - protein, 461 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKVAQVEYRRL

SEQ ID NO: 58431 - protein, 672 aa, Homo sapiens; identical to SEQ ID NO: 58428

SEQ ID NO: 58432 - protein, 489 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKVFGYLVFPMKRTGNTNKGALLAFYRLETKPCQPLSVH

SEQ ID NO: 58433 - protein, 141 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNY

SEQ ID NO: 58434 - protein, 472 aa, Homo sapiens
MDSTKEKCDSYKDDLLLRMGLNDNKAGMEGLDKEKINKIIMEATKGSRFYGNELKKEKQVNQRIENMMQQKAQITSQQLRKAQLQVDRFAMELEQSRNLSNTIVHIDMDAFYAAVEMRDNPELKDKPIAVGSMSMLSTSNYHARRFGVRAAMPGFIAKRLCPQLIIVPPNFDKYRAVSKEVKEILADYDPNFMAMSLDEAYLNITKHLEERQNWPEDKRRYFIKMGSSVENDNPGKEVNKLSEHERSISPLLFEESPSDVQPPGDPFQVNFEEQNNPQILQNSVVFGTSAQEVVKEIRFRIEQKTTLTASAGIAPNTMLAKVCSDKNKPNGQYQILPNRQAVMDFIKDLPIRKVSGIGKVTEKMLKALGIITCTELYQQRALLSLLFSETSWHYFLHISLGLGSTHLTRDGERKSMSVERTFSEINKAEEQYSLCQELCSELAQDLQKERLKVLYFDMVSLVFKFFNSKMLP

SEQ ID NO: 58435 - protein, 636 aa, Homo sapiens
MKCKCPVICFNAKDFVRIVLQFFGNDGSWKHVADFIGLDPRIAAWLIDPSDATPSFEDLVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEAVLNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVPLKVSLSAGRSWGHLVPLQEAWLRQAHVALSLPATAWLPLGPLPAPSPHPCIFRLHFVCSPRQQWEERTGFQQSIVWPSPRSPALYAPGRINPLGLGWPAIPWSKCLCKALLIL

SEQ ID NO: 58436 - protein, 311 aa, Homo sapiens
MAVGSQDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEAVNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQAQSQHLCVEVP

SEQ ID NO: 58437 - protein, 900 aa, Homo sapiens
MENYEALVGFDLCNTPLSSVAQKIMSAMHSGDLVDSKTWGKSTETMEVINKSSVKYSVQLEDRKTQSPEKKDLKSLRSQTSRGSAKLSPQSFSVRLTDQLSADQKQKSISSLTLSSCLIPQYNQEASVLQKKGHKRKHFLMENINNENKGSINLKRKHITYNNLSEKTSKQMALEEDTDDAEGYLNSGNSGALKKHFCDIRHLDDWAKSQLIEMLKQAAALVITVMYTDGSTQLGADQTPVSSVRGIVVLVKRQAEGGHGCPDAPACGPVLEGFVSDDPCIYIQIEHSAIWDQEQEAHQQFARNVLFQTMKCKCPVICFNAKDFVRIVLQFFGNDGSWKHVADFIGLDPRIAAWLIDPSDATPSFEDLVEKYCEKSITVKVNSTYGNSSRNIVNQNVRENLKTLYRLTMDLCSKLKDYGLWQLFRTLELPLIPILAVMESHAIQVNKEEMEKTSALLGARLKELEQEAHFVAGERFLITSNNQLREILFGKLKLHLLSQRNSLPRTGLQKYPSTSEAVLNALRDLHPLPKIILEYRQVHKIKSTFVDGLLACMKKGSISSTWNQTGTVTGRLSAKHPNIQGISKHPIQITTPKNFKGKEDKILTISPRAMFVSSKGHTFLAADFSQIELRILTHLSGDPELLKLFQESERDDVFSTLTSQWKDVPVEQVTHADREQTKKVVYAVVYGAGKERLAACLGVPIQEAAQFLESFLQKYKKIKDFARAAIAQCHQTGCVVSIMGRRRPLPRIHAHDQQLRAQAERQAVNFVVQGSAADLCKLAMIHVFTAVAASHTLTARLVAQIHDELLFEVEDPQIPECAALVRRTMESLEQVQALELQLQVPLKVSLSAGRSWGHLVPLQEAWGPPPGPCRTESPSNSLAAPGSPASTQPPPLHFSPSFCL

SEQ ID NO: 58438 - protein, 900 aa, Homo sapiens; identical to SEQ ID NO: 58437

SEQ ID NO: 58439 - protein, 1010 aa, Homo sapiens
RMDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERTRCSCWSTACPLTRSTTWSSSWPSPSCASSSPSWARAVPRLCYCGGTTRAARRCSRARWAASWPSPNAATAALAAAQCSATREPCVSSASPGSLSCIRRRYPI

SEQ ID NO: 58440 - protein, 1107 aa, Homo sapiens
MDGKRRPGPGPGVPPKRARGGLWDDDDAPRPSQFEEDLALMEEMEAEHRLQEQEEEELQSVLEGVADGQVPPSAIDPRWLRPTPPALDPQTEPLIFQQLEIDHYVGPAQPVPGGPPPSRGSVPVLRAFGVTDEGFSVCCHIHGFAPYFYTPAPPGFGPEHMGDLQRELNLAISRDSRGGRELTGPAVLAVELCSRESMFGYHGHGPSPFLRITVALPRLVAPARRLLEQGIRVAGLGTPSFAPYEANVDFEIRFMVDTDIVGCNWLELPAGKYALRLKEKATQCQLEADVLWSDVVSHPPEGPWQRIAPLRVLSFDIECAGRKGIFPEPERDPVIQICSLGLRWGEPEPFLRLALTLRPCAPILGAKVQSYEKEEDLLQAWSTFIRIMDPDVITGYNIQNFDLPYLISRAQTLKVQTFPFLGRVAGLCSNIRDSSFQSKQTGRRDTKVVSMVGRVQMDMLQVLLREYKLRSYTLNAVSFHFLGEQKEDVQHSIITDLQNGNDQTRRRLAVYCLKDAYLPLRLLERLMVLVNAVEMARVTGVPLSYLLSRGQQVKVVSQLLRQAMHEGLLMPVVKSEGGEDYTGATVIEPLKGYYDVPIATLDFSSLYPSIMMAHNLCYTTLLRPGTAQKLGLTEDQFIRTPTGDEFVKTSVRKGLLPQILENLLSARKRAKAELAKETDPLRRQVLDGRQLALKVSANSVYGFTGAQVGKLPCLEISQSVTGFGRQMIEKTKQLVESKYTVENGYSTSAKVVYGDTDSVMCRFGVSSVAEAMALGREAADWVSGHFPSPIRLEFEKVYFPYLLISKKRYAGLLFSSRPDAHDRMDCKGLEAVRRDNCPLVANLVTASLRRLLIDRDPEGAVAHAQDVISDLLCNRIDISQLVITKELTRAASDYAGKQAHVELAERMRKRDPGSAPSLGDRVPYVIISAAKGVAAYMKSEDPLFVLEHSLPIDTQYYLEQQLAKPLLRIFEPILGEGRAEAVLLRGDHTRCKTVLTGKVGGLLAFAKRRNCCIGCRTVLSHQGAVCEFCQPRESELYQKEVSHLNALEERFSRLWTQCQRCQGSLHEDVICTSRDCPIFYMRKKVRKDLEDQEQLLRRFGPPGPEAW

SEQ ID NO: 58441 - protein, 469 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVDVVTGQLGDEGEQCSAAHVSRVILAGNLLSHSTQSRDSINKAKYLTKKTQAASVEAVKMLDEILLQLSASVPVDVMPGEFDPTNYTLPQQPLHPCMFPLATAYSTLQLVTNPYQATIDGVRFLGTSGQNVSDIFRYSSMEDHLEILEWTLRVRHISPTAPDTLGCYPFYKTDPFIFPECPHVYFCGNTPSFGSKIIRGPEDQTVLLVTVPDFSATQTACLVNLRSLACQPISFSGFGAEDDDLGGLGLGP

SEQ ID NO: 58442 - protein, 148 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTI

SEQ ID NO: 58443 - protein, 220 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVTGTVLAVFGSVRDDGKFLVEDYCFADLAPQKPAPPLDTDRFVLLVSGLGLGGGGGESLLGTQLLVD

SEQ ID NO: 58444 - protein, 469 aa, Homo sapiens; identical to SEQ ID NO: 58441

SEQ ID NO: 58445 - protein, 155 aa, Homo sapiens
MFSEQAAQRAHTLLSPPSANNATFARVPVATYTNSSQPFRLGERSFSRQYAHIYATRLIQMRPFLENRAQQHWGSGVGVKKLCELQPEEKCCVVGTLFKAMPLQPSILREVSEEHNLLPQPPRSKYIHPDDELVLEDELQRIKLKGTIDVSKLVT

SEQ ID NO: 58446 - protein, 256 aa, Homo sapiens
MFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLKEADTPKCEEKERRKRELHSSATGRSCRGASEQRLGDAPSCRVVVHGVQACRMEGVCLKCRGVKETSMPVYCSCAGDFALTIHTQVFMEQIGIFRNIAQHYGMSYLLETLEWLLQKNPQLGH

SEQ ID NO: 58447 - protein, 2286 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 58448 - protein, 1109 aa, Homo sapiens
MHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKTAGEE

SEQ ID NO: 58449 - protein, 496 aa, Homo sapiens
MEGILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 58450 - protein, 2297 aa, Homo sapiens
MSRPLGLKSFPRHKQAPLPLSLTFHGCLLLRRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 58451 - protein, 2259 aa, Homo sapiens
MSLRSGGRRRADPGADGEASRDDGATSSVSALKRLERSQWTDKMDLRFGFERLKEPGEKTGWLINMHPVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPVEITRRDDLVERPDPVVLAFDIETTKLPLKFPDAETDQIMMISYMIDGQGYLITNREIVSEDIEDFEFTPKPEYEGPFCVFNEPDEAHLIQRWFEHVQETKPTIMVTYNGDFFDWPFVEARAAVHGLSMQQEIGFQKDSQGEYKAPQCIHMDCLRWVKRDSYLPVGSHNLKAAAKAKLGYDPVELDPEDMCRMATEQPQTLATYSVSDAVATYYLYMKYVHPFIFALCTIIPMEPDEVLRKGSGTLCEALLMVQAFHANIIFPNKQEQEFNKLTDDGHVLDSETYVGGHVEALESGVFRSDIPCRFRMNPAAFDFLLQRVEKTLRHALEEEEKVPVEQVTNFEEVCDEIKSKLASLKDVPSRIECPLIYHLDVGAMYPNIILTNRLQPSAMVDEATCAACDFNKPGANCQRKMAWQWRGEFMPASRSEYHRIQHQLESEKFPPLFPEGPARAFHELSREEQAKYEKRRLADYCRKAYKKIHITKVEERLTTICQRENSFYVDTVRAFRDRRYEFKGLHKVWKKKLSAAVEVGDAAEVKRCKNMEVLYDSLQLAHKCILNSFYGYVMRKGARWYSMEMAGIVCFTGANIITQARELIEQIGRPLELDTDGIWCVLPNSFPENFVFKTTNVKKPKVTISYPGAMLNIMVKEGFTNDQYQELAEPSSLTYVTRSENSIFFEVDGPYLAMILPASKEEGKKLKKRYAVFNEDGSLAELKGFEVKRRGELQLIKIFQSSVFEAFLKGSTLEEVYGSVAKVADYWLDVLYSKAANMPDSELFELISENRSMSRKLEDYGEQKSTSISTAKRLAEFLGDQMVKDAGLSCRYIISRKPEGSPVTERAIPLAIFQAEPTVRKHFLRKWLKSSSLQDFDIRAILDWDYYIERLGSAIQKIITIPAALQQVKNPVPRVKHPDWLHKKLLEKNDVYKQKKISELFTLEGRRQVTMAEASEDSPRPSAPDMEDFGLVKLPHPAAPVTVKRKRVLWESQEESQDLTPTVPWQEILGQPPALGTSQEEWLVWLRFHKKKWQLQARQRLARRKRQRLESAEGVLRPGAIRDGPATGLGSFLRRTARSILDLPWQIVQISETSQAGLFRLWALVGSDLHCIRLSIPRVFYVNQRVAKAEEGASYRKVNRVLPRSNMVYNLYEYSVPEDMYQEHINEINAELSAPDIEGVYETQVPLLFRALVHLGCVCVVNKQLVRHLSGWEAETFALEHLEMRSLAQFSYLEPGSIRHIYLYHHAQAHKALFGIFIPSQRRASVFVLDTVRSNQMPSLGALYSAEHGLLLEKVGPELLPPPKHTFEVRAETDLKTICRAIQRFLLAYKEERRGPTLIAVQSSWELKRLASEIPVLEEFPLVPICVADKINYGVLDWQRHGARRMIRHYLNLDTCLSQAFEMSRYFHIPIGNLPEDISTFGSDLFFARHLQRHNHLLWLSPTARPDLGGKEADDNCLVMEFDDQATVEINSSGCYSTVCVELDLQNLAVNTILQSHHVNDMEGADSMGISFDVIQQASLEDMITGGQAASAPASYDETALCSNTFRILKSMVVGWVKEITQYHNIYADNQVMHFYRWLRSPSSLLHDPALHRTLHNMMKKLFLQLIAEFKRLGSSVIYANFNRIILCTKKRRVEDAIAYVEYITSSIHSKETFHSLTISFSRCWEFLLWMDPSNYGGIKGKVSSRIHCGLQDSQKAGGAEDEQENEDDEEERDGEEEEEAEESNVEDLLENNWNILQFLPQAASCQNYFLMIVSAYIVAVYHCMKDGLRRSAPGSTPVRRRGASQLSQEAEGAVGALPGMITFSQDYVANELTQSFFTITQKIQKKVTGSRNSTELSEMFPVLPGSHLLLNNPALEFIKYVCKVLSLDTNITNQVNKLNRDLLRLVDVGEFSEEAQFRDPCRSYVLPEVICRSCNFCRDLDLCKDSSFSEDGAVLPQWLCSNCQAPYDSSAIEMTLVEVLQKKLMAFTLQDLVCLKCRGVKETSMPVYCSCAGDFALTIHTQVFMEQIGIFRNIAQHYGMSYLLETLEWLLQKNPQLGH

SEQ ID NO: 58452 - protein, 527 aa, Homo sapiens
MAPERLRSRALSAFKLRGLLLRGEAIKYLTEALQSISELELEDKLEKIINAVEKQPLSSNMIERSVVEAAVQECSQSVDETIEHVFNIIGAFDIPRFVYNSERKKFLPLLMTNHPAPNLFGTPRDKAEMFRERYTILHQRTHRHELFTPPVIGSHPDESGSKFQLKTIETLLGSTTKIGDAIVLGMITQLKEGKFFLEDPTGTVQLDLSKAQFHSGLYTEACFVLAEGWFEDQVFHVNAFGFPPTEPSSTTRAYYGNINFFGGPSNTSVKTSAKLKQLEEENKDAMFVFLSDVWLDQVEVLEKLRIMFAGYSPAPPTCFILCGNFSSAPYGKNQVQALKDSLKTLADIICEYPDIHQSSRFVFVPGPEDPGFGSILPRPPLAESITNEFRQRVPFSVFTTNPCRIQYCTQEITVFREDLVNKMCRNCVRFPSSNLAIPNHFVKTILSQGHLTPLPLYVCPVYWAYDYALRVYPVPDLLVIADKYDPFTTTNTECLCINPGSFPRSGFSFKVFYPSNKTVEDSKLQGF

SEQ ID NO: 58453 - protein, 501 aa, Homo sapiens
MAPERLRSRALSAFKLRGLLLRGEAIKYLTEALQSISELELEDKLEKIINAVEKQPLSSNMIERSVVEAAVQECSQSVDETILLMTNHPAPNLFGTPRDKAEMFRERYTILHQRTHRHELFTPPVIGSHPDESGSKFQLKTIETLLGSTTKIGDAIVLGMITQLKEGKFFLEDPTGTVQLDLSKAQFHSGLYTEACFVLAEGWFEDQVFHVNAFGFPPTEPSSTTRAYYGNINFFGGPSNTSVKTSAKLKQLEEENKDAMFVFLSDVWLDQVEVLEKLRIMFAGYSPAPPTCFILCGNFSSAPYGKNQVQALKDSLKTLADIICEYPDIHQSSRFVFVPGPEDPGFGSILPRPPLAESITNEFRQRVPFSVFTTNPCRIQYCTQEITVFREDLVNKMCRNCVRFPSSNLAIPNHFVKTILSQGHLTPLPLYVCPVYWAYDYALRVYPVPDLLVIADKYDPFTTTNTECLCINPGSFPRSGFSFKVFYPSNKTVEDSKLQGF

SEQ ID NO: 58454 - protein, 502 aa, Homo sapiens
MAPERLRSRALSAFKLRGLLLRGEAIKYLTEALQSISELELEDKLEKIINAVEKQPLSSNMIERSVVEAAVQECSQSVDETIEHVFNIIGAFDIPRFVYNSERKKFLPLLMTNHPAPNLFGTPRDKAEMFRERYTILHQRTHRHELFTPPVIGSHPDESGSKFQLKTIETLLGSTTKIGDAIVLGMITQLKEGKFFLEDPTGTVQLDLSKAQFHSGLYTEACFVLAEGWFEDQVFHVNAFGFPPTEPSSTTRAYYGNINFFGGPSNTSVKTSAKLKQLEEENKDAMFVFLSDVWLDQVEVLEKLRIMFAGYSPAPPTCFILCGNFSSAPYGKNQVQALKDSLKTLADIICEYPDIHQSSRFVFVPGPEDPGFGSILPRPPLAESITNEFRQRVPFSVFTTNPCRIQYCTQEITVFREDLVNKMCRNCVRFPSSNLAIPNHFVKTILSQGHLTPLPLYVCPVYWAYDYALRVYPVPDLLVIADKYDPFTTTNTECLCINPVRM

SEQ ID NO: 58455 - protein, 147 aa, Homo sapiens
MAERPEDLNLPNAVITRIIKEALPDGVNISKEARSAISRAASVFVLYATSCANNFAMKGKRKTLNASDVLSAMEEMEFQRFVTPLKEALEAYRREQKGKKEASEQKKKDKDKKTDSEEQDKSRDEDNDEDEERLEEEEQNEEEEVDN

SEQ ID NO: 58456 - protein, 147 aa, Homo sapiens; identical to SEQ ID NO: 58455

SEQ ID NO: 58457 - protein, 414 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTE

SEQ ID NO: 58458 - protein, 713 aa, Homo sapiens
MATGQDRVVALVDMDCFFVQVEQRQNPHLRNKPCAVVQYKSWKGGGIIAVSYEARAFGVTRSMWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 58459 - protein, 72 aa, Homo sapiens
MWADDAKKLCPDLLLAQVRESRGKANLTKYREASVEVMEIMSRFAVIERASIDEAYVDLTSAVQERLQKLQG

SEQ ID NO: 58460 - protein, 651 aa, Homo sapiens
MWADDAKKLCPDLLLAQVRESRGKANLTKYREASVEVMEIMSRFAVIERASIDEAYVDLTSAVQERLQKLQGQPISADLLPSTYIEGLPQGPTTAEETVQKEGMRKQGLFQWLDSLQIDNLTSPDLQLTVGAVIVEEMRAAIERETGFQCSAGISHNKVLAKLACGLNKPNRQTLVSHGSVPQLFSQMPIRKIRSLGGKLGASVIEILGIEYMGELTQFTESQLQSHFGEKNGSWLYAMCRGIEHDPVKPRQLPKTIGCSKNFPGKTALATREQVQWWLLQLAQELEERLTKDRNDNDRVATQLVVSIRVQGDKRLSSLRRCCALTRYDAHKMSHDAFTVIKNCNTSGIQTEWSPPLTMLFLCATKFSASAPSSSTDITSFLSSDPSSLPKVPVTSSEAKTQGSGPAVTATKKATTSLESFFQKAAERQKVKEASLSSLTAPTQAPMSNSPSKPSLPFQTSQSTGTEPFFKQKSLLLKQKQLNNSSVSSPQQNPWSNCKALPNSLPTEYPGCVPVCEGVSKLEESSKATPAEMDLAHNSQSMHASSASKSVLEVTQKATPNPSLLAAEDQVPCEKCGSLVPVWDMPEHMDYHFALELQKSFLQPHSSNPQVVSAVSHQGKRNPKSPLACTNKRPRPEGMQTLESFFKPLTH

SEQ ID NO: 58461 - protein, 1239 aa, Homo sapiens
MSRLLWRKVAGATVGPGPVPAPGRWVSSSVPASDPSDGQRRRQQQQQQQQQQQQQPQQPQVLSSEGGQLRHNPLDIQMLSRGLHEQIFGQGGEMPGEAAVRRSVEHLQKHGLWGQPAVPLPDVELRLPPLYGDNLDQHFRLLAQKQSLPYLEAANLLLQAQLPPKPPAWAWAEGWTRYGPEGEAVPVAIPEERALVFDVEVCLAEGTCPTLAVAISPSAWYSWCSQRLVEERYSWTSQLSPADLIPLEVPTGASSPTQRDWQEQLVVGHNVSFDRAHIREQYLIQGSRMRFLDTMSMHMAISGLSSFQRSLWIAAKQGKHKVQPPTKQGQKSQRKARRGPAISSWDWLDISSVNSLAEVHRLYVGGPPLEKEPRELFVKGTMKDIRENFQDLMQYCAQDVWATHEVFQQQLPLFLERCPHPVTLAGMLEMGVSYLPVNQNWERYLAEAQGTYEELQREMKKSLMDLANDACQLLSGERYKEDPWLWDLEWDLQEFKQKKAKKVKKEPATASKLPIEGAGAPGDPMDQEDLGPCSEEEEFQQDVMARACLQKLKGTTELLPKRPQHLPGHPGWYRKLCPRLDDPAWTPGPSLLSLQMRVTPKLMALTWDGFPLHYSERHGWGYLVPGRRDNLAKLPTGTTLESAGVVCPYRAIESLYRKHCLEQGKQQLMPQEAGLAEEFLLTDNSAIWQTVEELDYLEVEAEAKMENLRAAVPGQPLALTARGGPKDTQPSYHHGNGPYNDVDIPGCWFFKLPHKDGNSCNVGSPFAKDFLPKMEDGTLQAGPGGASGPRALEINKMISFWRNAHKRISSQMVVWLPRSALPRAVIRHPDYDEEGLYGAILPQVVTAGTITRRAVEPTWLTASNARPDRVGSELKAMVQAPPGYTLVGADVDSQELWIAAVLGDAHFAGMHGCTAFGWMTLQGRKSRGTDLHSKTATTVGISREHAKIFNYGRIYGAGQPFAERLLMQFNHRLTQQEAAEKAQQMYAATKGLRWYRLSDEGEWLVRELNLPVDRTEGGWISLQDLRKVQRETARKSQWKKWEVVAERAWKGGTESEMFNKLESIATSDIPRTPVLGCCISRALEPSAVQEEFMTSRVNWVVQSSAVDYLHLMLVAMKWLFEEFAIDGRFCISIHDEVRYLVREEDRYRAALALQITNLLTRCMFAYKLGLNDLPQSVAFFSAVDIDRCLRKEVTMDCKTPSNPTGMERRYGIPQGEALDIYQIIELTKGSLEKRSQPGP

SEQ ID NO: 58462 - protein, 1239 aa, Homo sapiens; identical to SEQ ID NO: 58461

SEQ ID NO: 58463 - protein, 485 aa, Homo sapiens
MRSRVAVRACHKVCRCLLSGFGGRVDAGQPELLTERSSPKGGHVKSHAELEGNGEHPEAPGSGEGSEALLEICQRRHFLSGSKQQLSRDSLLSGCHPGFGPLGVELRKNLAAEWWTSVVVFREQVFPVDALHHKPGPLLPGDSAFRLVSAETLREILQDKELSKEQLVAFLENVLKTSGKLRENLLHGALEHYVNCLDLVNKRLPYGLAQIGVCFHPVFDTKQIRNGVKSIGEKTEASLVWFTPPRTSNQWLDFWLRHRLQWWRKFAMSPSNFSSSDCQDEEGRKGNKLYYNFPWGKELIETLWNLGDHELLHMYPGNVSKLHGRDGRKNVVPCVLSVNGDLDRGMLAYLYDSFQLTENSFTRKKNLHRKVLKLHPCLAPIKVALDVGRGPTLELRQVCQGLFNELLENGISVWPGYLETMQSSLEQLYSKYDEMSILFTVLVTETTLENGLIHLRSRDTTMKEMMHISKLKDFLIKYISSAKNV

SEQ ID NO: 58464 - protein, 2590 aa, Homo sapiens
MNLLRRSGKRRRSESGSDSFSGSGGDSSASPQFLSGSVLSPPPGLGRCLKAAAAGECKPTVPDYERDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGESILICKNSEKSKGIALLQGSLKPVRSCLQRREGEEVTGSMIRAILEIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 58465 - protein, 2726 aa, Homo sapiens
MNGHRFTFRTRSLLPLQKGQHRCITKLLAHNDPWGIFRAPSSRRSYSVSGVCQPAIPNSSLHIPHNACWLKWKLCSEIALPYHHILGERRKLCSIRRFEFEDWREDVRSCCQARVLPRGRTLGLWLALIGREEFAMNLLRRSGKRRRSESGSDSFSGSGGDSSASPQFLSGSVLSPPPGLGRCLKAAAAGECKPTVPDYERDKLLLANWGLPKAVLEKYHSFGVKKMFEWQAECLLLGQVLEGKNLVYSAPTSAGKTLVAELLILKRVLEMRKKALFILPFVSVAKEKKYYLQSLFQEVGIKVDGYMGSTSPSRHFSSLDIAVCTIERANGLINRLIEENKMDLLGMVVVDELHMLGDSHRGYLLELLLTKICYITRKSASCQADLASSLSNAVQIVGMSATLPNLELVASWLNAELYHTDFRPVPLLESVKVGNSIYDSSMKLVREFEPMLQVKGDEDHVVSLCYETICDNHSVLLFCPSKKWCEKLADIIAREFYNLHHQAEGEGLVKPSECPPVILEQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVESILICKNSEKSKGIALLQGSLKPVRSCLQRREGEEVTGSMIRAILEIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 58466 - protein, 2213 aa, Homo sapiens
MPTSNSQKELLEVMDQLRRLPSGLDSVLQKTVPWGVAFHHAGLTFEERDIIEGAFRQGLIRVLAATSTLSSGVNLPARRVIIRTPIFGGRPLDILTYKQMVGRAGRKGVDTVGESILICKNSEKSKGIALLQGSLKPVRSCLQRREGEEVTGSMIRAILEIIVGGVASTSQDMHTYAACTFLAASMKEGKQGIQRNQESVQLGAIEACVMWLLENEFIQSTEASDGTEGKVYHPTHLGSATLSSSLSPADTLDIFADLQRAMKGFVLENDLHILYLVTPMFEDWTTIDWYRFFCLWEKLPTSMKRVAELVGVEEGFLARCVKGKVVARTERQHRQMAIHKRFFTSLVLLDLISEVPLREINQKYGCNRGQIQSLQQSAAVYAGMITVFSNRLGWHNMELLLSQFQKRLTFGIQRELCDLVRVSLLNAQRARVLYASGFHTVADLARANIVEVEVILKNAVPFKSARKAVDEEEEAVEERRNMRTIWVTGRKGLTEREAAALIVEEARMILQQDLVEMGVQWNPCALLHSSTCSLTHSESEVKEHTFISQTKSSYKKLTSKNKSNTIFSDSYIKHSPNIVQDLNKSREHTSSFNCNFQNGNQEHQTCSIFRARKRASLDINKEKPGASQNEGKTSDKKVVQTFSQKTKKAPLNFNSEKMSRSFRSWKRRKHLKRSRDSSPLKDSGACRIHLQGQTLSNPSLCEDPFTLDEKKTEFRNSGPFAKNVSLSGKEKDNKTSFPLQIKQNCSWNITLTNDNFVEHIVTGSQSKNVTCQATSVVSEKGRGVAVEAEKINEVLIQNGSKNQNVYMKHHDIHPINQYLRKQSHEQTSTITKQKNIIERQMPCEAVSSYINRDSNVTINCERIKLNTEENKPSHFQALGDDISRTVIPSEVLPSAGAFSKSEGQHENFLNISRLQEKTGTYTTNKTKNNHVSDLGLVLCDFEDSFYLDTQSEKIIQQMATENAKLGAKDTNLAAGIMQKSLVQQNSMNSFQKECHIPFPAEQHPLGATKIDHLDLKTVGTMKQSSDSHGVDILTPESPIFHSPILLEENGLFLKKNEVSVTDSQLNSFLQGYQTQETVKPVILLIPQKRTPTGVEGECLPVPETSLNMSDSLLFDSFSDDYLVKEQLPDMQMKEPLPSEVTSNHFSDSLCLQEDLIKKSNVNENQDTHQQLTCSNDESIIFSEMDSVQMVEALDNVDIFPVQEKNHTVVSPRALELSDPVLDEHHQGDQDGGDQDERAEKSKLTGTRQNHSFIWSGASFDLSPGLQRILDKVSSPLENEKLKSMTINFSSLNRKNTELNEEQEVISNLETKQVQGISFSSNNEVKSKIEMLENNANHDETSSLLPRKESNIVDDNGLIPPTPIPTSASKLTFPGILETPVNPWKTNNVLQPGESYLFGSPSDIKNHDLSPGSRNGFKDNSPISDTSFSLQLSQDGLQLTPASSSSESLSIIDVASDQNLFQTFIKEWRCKKRFSISLACEKIRSLTSSKTATIGSRFKQASSPQEIPIRDDGFPIKGCDDTLVVGLAVCWGGRDAYYFSLQKEQKHSEISASLVPPSLDPSLTLKDRMWYLQSCLRKESDKECSVVIYDFIQSYKILLLSCGISLEQSYEDPKVACWLLDPDSQEPTLHSIVTSFLPHELPLLEGMETSQGIQSLGLNAGSEHSGRYRASVESILIFNSMNQLNSLLQKENLQDVFRKVEMPSQYCLALLELNGIGFSTAECESQKHIMQAKLDAIETQAYQLAGHSFSFTSSDDIAEVLFLELKLPPNREMKNQGSKKTLGSTRRGIDNGRKLRLGRQFSTSKDVLNKLKALHPLPGLILEWRRITNAITKVVFPLQREKCLNPFLGMERIYPVSQSHTATGRITFTEPNIQNVPRDFEIKMPTLVGESPPSQAVGKGLLPMGRGKYKKGFSVNPRCQAQMEERAADRGMPFSISMRHAFVPFPGGSILAADYSQLELRILAHLSHDRRLIQVLNTGADVFRSIAAEWKMIEPESVGDDLRQQAKQICYGIIYGMGAKSLGEQMGIKENDAACYIDSFKSRYTGINQFMTETVKNCKRDGFVQTILGRRRYLPGIKDNNPYRKAHAERQAINTIVQGSAADIVKIATVNIQKQLETFHSTFKSHGHREGMLQSDQTGLSRKRKLQGMFCPIRGGFFILQLHDELLYEVAEEDVVQVAQIVKNEMESAVKLSVKLKVKVKIGASWGELKDFDV

SEQ ID NO: 58467 - protein, 79 aa, Homo sapiens
MGRKRLITDSYPVVKRREGPAGHSKGELAPELGEEPQPRDEEEAELELLRQFDLAWQYGPCTVSGISIPYEAPRKTSCP

SEQ ID NO: 58468 - protein, 107 aa, Homo sapiens
MGRKRLITDSYPVVKRREGPAGHSKGELAPELGEEPQPRDEEEAELELLRQFDLAWQYGPCTGITRLQRWCRAKQMGLEPPPEVWQVLKTHPGDPRFQCSLWHLYPL

SEQ ID NO: 58469 - protein, 34 aa, Homo sapiens
MGRKRLITDSYPVVKRREGPAGHSKGELAPELGL

SEQ ID NO: 58470 - protein, 421 aa, Homo sapiens
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPQQKAMAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASVTTQPTEFKIKL

SEQ ID NO: 58471 - protein, 185 aa, Homo sapiens
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVGLRAVPLLCLVSGGAWVGSRSQASCPLPSGSRPH

SEQ ID NO: 58472 - protein, 392 aa, Homo sapiens
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGQPMKCNLHMNGNVITSDQPILLRLSDSPSMKKESELPRRVNSASSSNPPAEVDPDTILKALFKSSGASVTTQPTEFKIKL

SEQ ID NO: 58473 - protein, 229 aa, Homo sapiens [sequence omitted]

SEQ ID NO: 58474 - protein, 186 aa, Homo sapiens
MAPLHPHPAGMRINVVNNHQAKQNLYDLDEDDDGIASVPTKQMKFAASGGFLHHMAGLSSSKLSMSKALPLTKVVQNDAYTAPALPSSIRTKALTNMSRTLVNKEEPPKELPAAEPVLSPLEGTKMTVNNLHPRVTEEDIVELFCVCGALKRARLVHPGVAEVVFVKKDDAITAYKKYNNRCLDGG

SEQ ID NO: 58475 - protein, 184 aa, Homo sapiens
MADISLDELIRKRGAAAKGRLNARPGVGGVRSRVGIQQGLLSQSTRTATFQQRFDARQKIGLSDARLKLGVKDAREKLLQKDARFRIKGKVQDAREMLNSRKQQTTVPQKPRQVADAREKISLKRSSPAAFINPPIGTVTPALKLTKTIQVPSFPCPRPSLSPKWFRMMHTQLLLSLPLFEQKP

SEQ ID NO: 58476 - protein, 117 aa, Homo sapiens
MAAAAAAGSGTPREEEGPAGEAAASQPQAPTSVPGARLSRLPLARVKALVKADPDVTLAGQEAIFILARAAELFVETIAKDAYCCAQQGKRKTLQRRDLDNAIEAVDEFAFLEGTLD

SEQ ID NO: 58477 - protein, 342 aa, Homo sapiens
MAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYICKKDLLAAVAHTCNPSTLGGQGEWITGSRERDHPG

SEQ ID NO: 58478 - protein, 210 aa, Homo sapiens
MAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKKVARVANPRLDTFSREIFRNEKLKKVVRLARVRDHYIFSVESTGVLPPDVLVSEAIKVLMGKCRRFLDELDAVQMD

SEQ ID NO: 58479 - protein, 346 aa, Homo sapiens
MAASQAVEEMRSRVVLGEFGVRNVHTTDFPGNYSGYDDAWDQDRFEKNFRVDVVHMDENSLEFDMVGIDAAIANAFRRILLAEVPTMAVEKVLVYNNTSIVQDEILAHRLGLIPIHADPRLFEYRNQGDEEGTEIDTLQFRLQVRCTRNPHAAKDSSDPNELYVNHKVYTRHMTWIPLGNQADLFPEGTIRPVHDDILIAQLRPGQEIDLLMHCVKGIGKDHAKFSPVATASYRLLPDITLLEPVEGEAAEELSRCFSPGVIEVQEVQGKKVARVANPRLDTFSREIFRNEKLKKVVRLARVRDHYIFSVESTGVLPPDVLVSEAIKVLMGKCRRFLDELDAVQMD

SEQ ID NO: 58480 - protein, 122 aa, Homo sapiens
MEEDQELERKAIEELLKEAKRGKTRAETMGPMGWMKCPLASTNKRFLINTIKNTLPSHKEQDHEQKEGDKEPAKSQAQKEENPKKHRSHPYKHSFRARGSASYSPPRKRSSQDKYEKRSNRR

SEQ ID NO: 58481 - protein, 133 aa, Homo sapiens
MEEDQELERKISGLKTSMAEGERKTALEMVQAAGTDRHCVTFVLHEEDHTLGNSLRYMIMKNPEVEFCGYTTTHPSESKINLRIQTRGTLPAVEPFQRGLNELMNVCQHVLDKFEASIKDYKDQKASRNESTF

SEQ ID NO: 58482 - protein, 133 aa, Homo sapiens; identical to SEQ ID NO: 58481

SEQ ID NO: 58483 - protein, 1970 aa, Homo sapiens
MHGGGPPSGDSACPLRTIKRVQFGVLSPDELKRMSVTEGGIKYPETTEGGRPKLGGLMDPRQGVIERTGRCQTCAGNMTECPGHFGHIELAKPVFHVGFLVKTMKVLRCVCFFCSKLLVDSNNPKIKDILAKSKGQPKKRLTHVYDLCKGKNICEGGEEMDNKFGVEQPEGDEDLTKEKGHGGCGRYQPRIRRSGLELYAEWKHVNEDSQEKKILLSPERVHEIFKRISDEECFVLGMEPRYARPEWMIVTVLPVPPLSVRPAVVMQGSARNQDDLTHKLADIVKINNQLRRNEQNGAAAHVIAEDVKLLQFHVATMVDNELPGLPRAMQKSGRPLKSLKQRLKGKEGRVRGNLMGKRVDFSARTVITPDPNLSIDQVGVPRSIAANMTFAEIVTPFNIDRLQELVRRGNSQYPGAKYIIRDNGDRIDLRFHPKPSDLHLQTGYKVERHMCDGDIVIFNRQPTLHKMSMMGHRVRILPWSTFRLNLSVTTPYNADFDGDEMNLHLPQSLETRAEIQELAMVPRMIVTPQSNRPVMGIVQDTLTAVRKFTKRDVFLERGEVMNLLMFLSTWDGKVPQPAILKPRPLWTGKQIFSLIIPGHINCIRTHSTHPDDEDSGPYKHISPGDTKVVVENGELIMGILCKKSLGTSAGSLVHISYLEMGHDITRLFYSNIQTVINNWLLIEGHTIGIGDSIADSKTYQDIQNTIKKAKQDVIEVIEKAHNNELEPTPGNTLRQTFENQVNRILNDARDKTGSSAQKSLSEYNNFKSMVVSGAKGSKINISQVIAVVGQQNVEGKRIPFGFKHRTLPHFIKDDYGPESRGFVENSYLAGLTPTEFFFHAMGGREGLIDTAVKTAETGYIQRRLIKSMESVMVKYDATVRNSINQVVQLRYGEDGLAGESVEFQNLATLKPSNKAFEKKFRFDYTNERALRRTLQEDLVKDVLSNAHIQNELEREFERMREDREVLRVIFPTGDSKVVLPCNLLRMIWNAQKIFHINPRLPSDLHPIKVVEGVKELSKKLVIVNGDDPLSRQAQENATLLFNIHLRSTLCSRRMAEEFRLSGEAFDWLLGEIESKFNQAIAHPGEMVGALAAQSLGEPATQMTLNTFHYAGVSAKNVTLGVPRLKELINISKKPKTPSLTVFLLGQSARDAERAKDILCRLEHTTLRKVTANTAIYYDPNPQSTVVAEDQEWVNVYYEMPDFDVARISPWLLRVELDRKHMTDRKLTMEQIAEKINAGFGDDLNCIFNDDNAEKLVLRIRIMNSDENKMQEEEEVVDKMDDDVFLRCIESNMLTDMTLQGIEQISKVYMHLPQTDNKKKIIITEDGEFKALQEWILETDGVSLMRVLSEKDVDPVRTTSNDIVEIFTVLGIEAVRKALERELYHVISFDGSYVNYRHLALLCDTMTCRGHLMAITRHGVNRQDTGPLMKCSFEETVDVLMEAAAHGESDPMKGVSENIMLGQLAPAGTGCFDLLLDAEKCKYGMEIPTNIPGLGAAGPTGMFFGSAPSPMGGISPAMTPWNQGATPAYGAWSPSVGSGMTPGAAGFSPSAASDASGFSPGYSPAWSPTPGSPGSPGPSSPYIPSPGGAMSPSYSPTSPAYEPRSPGGYTPQSPSYSPTSPSYSPTSPSYSPTSPNYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPSYSPTSPNYSPTSPNYTPTSPSYSPTSPSYSPTSPNYTPTSPNYSPTSPSYSPTSPSYSPTSPSYSPSSPRYTPQSPTYTPSSPSYSPSSPSYSPASPKYTPTSPSYSPSSPEYTPTSPKYSPTSPKYSPTSPKYSPTSPTYSPTTPKYSPTSPTYSPTSPVYTPTSPKYSPTSPTYSPTSPKYSPTSPTYSPTSPKGSTYSPTSPGYSPTSPTYSLTSPAISPDDSDEEN

SEQ ID NO: 58484 - protein, 275 aa, Homo sapiens
MPYANQPTVRITELTDENVKFIIENTDLAVANSIRRVFIAEVPIIAIDWVQIDANSSVLHDEFIAHRLGLIPLISDDIVDKLQYSRDCTCEEFCPECSVEFTLDVRCNEDQTRHVTSRDLISNSPRVIPVTSRNRDNDPNDYVEQDDILIVKLRKGQELRLRAYAKKGFGKEHAKWNPTAGVAFEYDPDNALRHTVYPKPEEWPKSEYSELDEDESQAPYDPNGKPERFYYNVESCGSLRPETIVLSALSGLKKKLSDLQTQLSHEIQSDVLTIN

SEQ ID NO: 58485 - protein, 210 aa, Homo sapiens
MDDEEETYRLWKIRKTIMQLCHDRGYLVTQDELDQTLEEFKAQSGDKPSEGRPRRTDLTVLVAHNDDPTDQMFVFFPEEPKVGIKTIKVYCQRMQEENITRALIVVQQGMTPSAKQSLVDMAPKYILEQFLQQELLINITEHELVPEHVVMTKEEVTELLARYKLRENQLPRIQAGDPVARYFGIKRGQVVKIIRPSETAGRYITYRLVQ

SEQ ID NO: 58486 - protein, 126 aa, Homo sapiens
MSDNEDNFDGDDFDDVEEDEGLDDLENAEEEGQENVEILPSGERPQANQKRITTPYMTKYERARVLGTRALQIAMCAPVMVELEGETDPLLIAMKELKLLWGLEYTVLRPSYALAHSLGSFSISSR

SEQ ID NO: 58487 - protein, 158 aa, Homo sapiens
MSDNEDNFDGDDFDDVEEDEGLDDLENAEEEGQENVEILPSGERPQANQKRITTPYMTKYERARVLGTRALQIAMCAPVMVELEGETDPLLIAMKELNARSASEPPGEEPPWMDRGTRDEHLPSCPGCPAVASNTRCCPPAACLPGISLSRRRRLREE

SEQ ID NO: 58488 - protein, 127 aa, Homo sapiens
MSDNEDNFDGDDFDDVEEDEGLDDLENAEEEGQENVEILPSGERPQANQKRITTPYMTKYERARVLGTRALQIAMCAPVMVELEGETDPLLIAMKELKARKIPIIIRRYLPDGSYEDWGVDELIITD

SEQ ID NO: 58489 - protein, 172 aa, Homo sapiens
MFYHISLEHEILLHPRYFGPNLLNTVKQKLFTEVEGTCTGKYGFVIAVTTIDNIGAGVIQPGRGFVLYPVKYKAIVFRPFKGEVVDAVVTQVNKVGLFTEIGPMSCFISRHSIPSEMEFDPNSNPPCYKTMDEDIVIQQDDEIRLKIVGTRVDKNDIFAIGSLMDDYLGLVS

SEQ ID NO: 58490 - protein, 150 aa, Homo sapiens
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLAF

SEQ ID NO: 58491 - protein, 12 aa, Homo sapiens
MAGILFEDIFDV

SEQ ID NO: 58492 - protein, 149 aa, Homo sapiens
MAGILFEDIFDVKDIDPEGKKFDRVSRLHCESESFKMDLILDVNIQIYPVDLGDKFRLVIASTLYEDGTLDDGEYNPTDDRPSRADQFEYVMYGKVYRIEGDETSTEAATRLSAYVSYGGLLMRLQGDANNLHGFEVDSRVYLLMKKLA

SEQ ID NO: 58493 - protein, 150 aa, Homo sapiens; identical to SEQ ID NO: 58490

SEQ ID NO: 58494 - protein, 125 aa, Homo sapiens
MEPDGTYEPGFVGIRFCQECNNMLYPKEDKENRILLYACRNCDYQQEADNSCIYVNKITHEVDELTQIIADVSQDPTLPRTEDHPCQKCGHKEAVFFQSHSARAEDAMRLYYVCTAPHCGHRWTE

SEQ ID NO: 58495 - protein, 117 aa, Homo sapiens
MNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRVAIKDKQEGIE

SEQ ID NO: 58496 - protein, 127 aa, Homo sapiens
MNAPPAFESFLLFEGEKKITINKDTKVPNACLFTINKEDHTLGNIIKSQLLKDPQVLFAGYKVPHPLEHKIIIRVQTTPDYSPQEAFTNAITDLISELSLLEERFRVRAGPGGADGVAIKDKQEGIE

SEQ ID NO: 58497 - protein, 116 aa, Homo sapiens
MNAPPAFESFLLFEGEKITINKDTKVPKACLFTINKEDHTLGNIIKSRACFPFAFCRDCQFPEASPATLPVQPAELCPRAHQLCAPALKRHLGGEAHPVHLHAGAASRPVQQPQHL

SEQ ID NO: 58498 - protein, 115 aa, Homo sapiens
MNAPPAFESFLLFEGEKITINKDTKVPKACLFTINKEDHTLGNIIKSQLLKDPQVLFAGYKVPHPLEHKIIIRVQTTPDYSPQEAFTNAITDLISELSLLEERFRTCLLPLRLLP

SEQ ID NO: 58499 - protein, 58 aa, Homo sapiens
MDTQKDVQPPKQQPMIYICGECHTENEIKSRDPIRCRECGYRIMYKKRTKRLVVFDAR

SEQ ID NO: 58500 - protein, 67 aa, Homo sapiens
MIIPVRCFTCGKIVGNKWEAYLGLLQAEYTEGDALDALGLKRYCCRRMLLAHVDLIEKLLNYAPLEK

SEQ ID NO: 58501 - protein, 67 aa, Homo sapiens; identical to SEQ ID NO: 58500

SEQ ID NO: 58502 - protein, 1390 aa, Homo sapiens
MVKEQFRETDVAKKISHICFGMKSPEEMRQQAHIQVVSKNLYSQDNQHAPLLYGVLDHRMGTSEKDRPCETCGKNLADCLGHYGYIDLELPCFHVGYFRAVIGILQMICKTCCHIMLSQEEKKQFLDYLKRPGLTYLQKRGLKKKISDKCRKKNICHHCGAFNGTVKKCGLLKIIHEKYKTNKKVVDPIVSNFLQSFETAIEHNKEVEPLLGRAQENLNPLVVLNLFKRIPAEDVPLLLMNPEAGKPSDLILTRLLVPPLCIRPSVVSDLKSGTNEDDLTMKLTEIIFLNDVIKKHRISGAKTQMIMEDWDFLQLQCALYINSELSGIPLNMAPKKWTRGFVQRLKGKQGRFRGNLSGKRVDFSGRTVISPDPNLRIDEVAVPVHVAKILTFPEKVNKANINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKPVTLWTGKQIFSVILRPSDDNPVRANLRTKGKQYCGKGEDLCANDSYVTIQNSELMSGSMDKGTLGSGSKNNIFYILLRDWGQNEAADAMSRLARLAPVYLSNRGFSIGIGDVTPGQGLLKAKYELLNAGYKKCDEYIEALNTGKLQQQPGCTAEETLEALILKELSVIRDHAGSACLRELDKSNSPLTMALCGSKGSFINISQMIACVGQQAISGSRVPDGFENRSLPHFEKHSKLPAAKGFVANSFYSGLTPTEFFFHTMAGREGLVDTAVKTAETGYMQRRLVKSLEDLCSQYDLTVRSSTGDIIQFIYGGDGLDPAAMEGKDEPLEFKRVLDNIKAVFPCPSEPALSKNELILTTESIMKKSEFLCCQDSFLQEIKKFIKGVSEKIKKTRDKYGINDNGTTEPRVLYQLDRITPTQVEKFLETCRDKYMRAQMEPGSAVGALCAQSIGEPGTQMTLKTFHFAGVASMNITLGVPRIKEIINASKAISTPIITAQLDKDDDADYARLVKGRIEKTLLGEISEYIEEVFLPDDCFILVKLSLERIRLLRLEVNAETVRYSICTSKLRVKPGDVAVHGEAVVCVTPRENSKSSMYYVLQFLKEDLPKVVVQGIPEVSRAVIHIDEQSGKEKYKLLVEGDNLRAVMATHGVKGTRTTSNNTYEVEKTLGIEAARTTIINEIQYTMVNHGMSIDRRHVMLLSDLMTYKGEVLGITRFGLAKMKESVLMLASFEKTADHLFDAAYFGQKDSVCGVSECIIMGIPMNIGTGLFKLLHKADRDPNPPKRPLIFDTNEFHIPLVT

SEQ ID NO: 58503 - protein, 162 aa, Homo sapiens [sequence omitted]

SEQ ID NO: 58504 - protein, 1369 aa, Homo sapiens
MVKEQFRETDVAKKISHICFGMKSPEEMRQQAHIQVVSKNLYSQDNQHAPLLYGVLDHRMGTSEKDRPCETCGKNLADCLGHYGYIDLELPCFHVGYFRAVIGILQMICKTCCHIMLSQEEKKQFLDYLKRPGLTYLQKRGLKKKISDKCRKKNICHHCGAFNGTVKKCGLLKIIHEKYKTNKKVVDPIVSNFLQSFETAIEHNKEVEPLLGRAQENLNPLVVLNLFKRIPAEDVPLLLMNPEAGKPSDLILTRLLVPPLCIRPSVVSDLKSGTNEDDLTMKLTEIIFLNDVIKKHRISGAKTQMIMEDWDFLQLQCALYINSELSGIPLNMAPKKWTRGFVQRLKGKQGRFRGNLSGKRVDFSGRTVISPDPNLRIDEVAVPVHVAKILTFPEKVNKANINFLRKLVQNGPEVHPGANFIQQRHTQMKRFLKYGNREKMAQELKYGDIVERHLIDGDVVLFNRQPSLHKLSIMAHLARVKPHRTFRFNECVCTPYNADFDGDEMNLHLPQTEEAKAEALVLMGTKANLVTPRNGEPLIAAIQDFLTGAYLLTLKDTFFDRAKACQIIASILVGKDEKIKVRLPPPTILKPVTLWTGKQIFSVILRPSDDNPVRANLRTKGKQYCGKGEDLCANDSYVTIQNSELMSGSMDKGTLGSGSKNNIFYILLRDWGQNEAADAMSRLARLAPVYLSNRGFSIGIGDVTPGQGLLKAKYELLNAGYKKCDEYIEALNTGKLQQQPGCTAEETLEALILKELSVIRDHAGSACLRELDKSNSPLTMALCGSKGSFINISQMIACVGQQAISGSRVPDGFENRSLPHFEKHSKLPAAKGFVANSFYSGLTPTEFFFHTMAGREGLVDTAVKTAETGYMQRRLVKSLEDLCSQYDLTVRSSTGDIIQFIYGGDGLDPAAMEGKDEPLEFKRVLDNIKAVFPCPSEPALSKNELILTTESIMKKSEFLCCQDSFLQEIKKFIKGVSEKIKKTRDKYGINDNGTTEPRVLYQLDRITPTQVEKFLETCRDKYMRAQMEPGSAVGALCAQRNITLGVPRIKEIINASKAISTPIITAQLDKDDDADYARLVKGRIEKTLLGEISEYIEEVFLPDDCFILVKLSLERIRLLRLEVNAETVRYSICTSKLRVKPGDVAVHGEAVVCVTPRENSKSSMYYVLQFLKEDLPKVVVQGIPEVSRAVIHIDEQSGKEKYKLLVEGDNLRAVMATHGVKGTRTTSNNTYEVEKTLGIEAARTTIINEIQYTMVNHGMSIDRRHVMLLSDLMTYKGEVLGITRFGLAKMKESVLMLASFEKTADHLFDAAYFGQKDSVCGVSECIIMGIPMNIGTGLFKLLHKADRDPNPPKRPLIFDTNEFHIPLVT

SEQ ID NO: 58505 - protein, 1133 aa, Homo sapiens
MDVLAEEFGNLTPEQLAAPIPTVEEKWRLLPAFLKVKGLVKQHIDSFNYFINVEIKKIMKANEKVTSDADPMWYLKYLNIYVGLPDVEESFNVTRPVSPHECRLRDMTYSAPITVDIEYTRGSQRIIRNALPIGRMPIMLRSSNCVLTGKTPAEFAKLNECPLDPGGYFIVKGVEKVILIQEQLSKNRIIVEADRKGAVGASVTSSTHEKKSRTNMAVKQGRFYLRHNTLSEDIPIVIIFKAMGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRNFEDFLHESLVEYLDVNEENDCNIALYEHTINKDTTHLEIEPFTLLGVCAGLIPYPHHNQSPRNTYQCAMGKQAMGTIGYNQRNRIDTLMYLLAYPQKPMVKTKTIELIEFEKLPAGQNATVAVMSYSGYDIEDALVLNKASLDRGFGRCLVYKNAKCTLKRYTNQTFDKVMGPMLDAATRKPIWRHEILDADGICSPGEKVENKQVLVNKSMPTVTQIPLEGSNVPQQPQYKDVPITYKGATDSYIEKVMISSNAEDAFLIKMLLRQTRRPEIGDKFSSRHGQKGVCGLIVPQEDMPFCDSGICPDIIMNPHGFPSRMTVGKLIELLAGKAGVLDGRFHYGTAFGGSKVKDVCEDLVRHGYNYLGKDYVTSGITGEPLEAYIYFGPVYYQKLKHMVLDKMHARARGPRAVLTRQPTEGRSRDGGLRLGEMERDCLIGYGASMLLLERLMISSDAFEVDVCGQCGLLGYSGWCHYCKSSCHVSSLRIPYACKLLFQELQSMNIIPRLKLSKYNE

SEQ ID NO: 58506 - protein, 1075 aa, Homo sapiens
MKANEKVTSDADPMWYLKYLNIYVGLPDVEESFNVTRPVSPHECRLRDMTYSAPITVDIEYTRGSQRIIRNALPIGRMPIMLRSSNCVLTGKTPAEFAKLNECPLDPGGYFIVKGVEKVILIQEQLSKNRIIVEADRKGAVGASVTSSTHEKKSRTNMAVKQGRFYLRHNTLSEDIPIVIIFKAMGVESDQEIVQMIGTEEHVMAAFGPSLEECQKAQIFTQMQALKYIGNKVRRQRMWGGGPKKTKIEEARELLASTILTHVPVKEFNFRAKCIYTAVMVRRVILAQGDNKVDDRDYYGNKRLELAGQLLSLLFEDLFKKFNSEMKKIADQVIPKQRAAQFDVVKHMRQDQITNGMVNAISTGNWSLKRFKMDRQGVTQVLSRLSYISALGMMTRISSQFEKTRKVSGPRSLQPSQWGMLCPSDTPEGEACGLVKNLALMTHITTDMEDGPIVKLASNLGVEDVNLLCGEELSYPNVFLVFLNGNILGVIRDHKKLVNTFRLMRRAGYINEFVSISTNLTDRCVYISSDGGRLCRPYIIVKKQKPAVTNKHMEELAQGYRNFEDFLHESLVEYLDVNEENDCNIALYEHTINKDTTHLEIEPFTLLGVCAGLIPYPHHNQSPRNTYQCAMGKQAMGTIGYNQRNRIDTLMYLLAYPQKPMVKTKTIELIEFEKLPAGQNATVAVMSYSGYDIEDALVLNKASLDRGFGRCLVYKNAKCTLKRYTNQTFDKVMGPMLDAATRKPIWRHEILDADGICSPGEKVENKQVLVNKSMPTVTQIPLEGSNVPQQPQYKDVPITYKGATDSYIEKVMISSNAEDAFLIKMLLRQTRRPEIGDKFSSRHGQKGVCGLIVPQEDMPFCDSGICPDIIMNPHGFPSRMTVGKLIELLAGKAGVLDGRFHYGTAFGGSKVKDVCEDLVRHGYNYLGKDYVTSGITGEPLEAYIYFGPVYYQKLKHMVLDKMHARARGPRAVLTRQPTEGRSRDGGLRLGEMERDCLIGYGASMLLLERLMISSDAFEVDVCGQCGLLGYSGWCHYCKSSCHVSSLRIPYACKLLFQELQSMNIIPRLKLSKYNE

SEQ ID NO: 58507 - protein, 1230 aa, Homo sapiens
MSALCWGRGAAGLKRALRPCGRPGLPGKEGTAGGVCGPRRSSSASPQEQDQDRRKDWGHVELLEVLQARVRQLQAESVSEVVVNRVDVARLPECGSGDGSLQPPRKVQMGAKDATPVPCGRWAKILEKDKRTQQMRMQRLKAKLQMPFQSGEFKALTRRLQVEPRLLSKQMAGCLEDCTRQAPESPWEEQLARLLQEAPGKLSLDVEQAPSGQHSQAQLSGQQQRLLAFFKCCLLTDQLPLAHHLLVVHHGQRQKRKLLTLDMYNAVMLGWARQGAFKELVYVLFMVKDAGLTPDLLSYAAALQCMGRQDQDAGTIERCLEQMSQEGLKLQALFTAVLLSEEDRATVLKAVHKVKPTFSLPPQLPPPVNTSKLLRDVYAKDGRVSYPKLHLPLKTLQCLFEKQLHMELASRVCVVSVEKPTLPSKEVKHARKTLKTLRDQWEKALCRALRETKNRLEREVYEGRFSLYPFLCLLDEREVVRMLLQVLQALPAQGESFTTLARELSARTFSRHVVQRQRVSGQVQALQNHYRKYLCLLASDAEVPEPCLPRQYWEELGAPEALREQPWPLPVQMELGKLLAEMLVQATQMPCSLDKPHRSSRLVPVLYHVYSFRNVQQIGILKPHPAYVQLLEKAAEPTLTFEAVDVPMLCPPLPWTSPHSGAFLLSPTKLMRTVEGATQHQELLETCPPTALHGALDALTQLGNCAWRVNGRVLDLVLQLFQAKGCPQLGVPAPPSEAPQPPEAHLPHSAAPARKAELRRELAHCQKVAREMHSLRAEALYRLSLAQHLRDRVFWLPHNMDFRGRTYPCPPHFNHLGSDVARALLEFAQGRPLGPHGLDWLKIHLVNLTGLKKREPLRKRLAFAEEVMDDILDSADQPLTGRKWWMGAEEPWQTLACCMEVANAVRASDPAAYVSHLPVHQDGSCNGLQHYAALGRDSVGAASVNLEPSDVPQDVYSGVAAQVEVFRRQDAQRGMRVAQVLEGFITRKVVKQTVMTVVYGVTRYGGRLQIEKRLRELSDFPQEFVWEASHYLVRQVFKSLQEMFSGTRAIQHWLTESARLISHMGSVVEWVTPLGVPVIQPYRLDSKVKQIGGGIQSITYTHNGDISRKPNTRKQKNGFPPNFIHSLDSSHMMLTALHCYRKGLTFVSVHDCYWTHAADVSVMNQVCREQFVRLHSEPILQDLSRFLVKRFCSEPQKILEASQLKETLQAVPKPGAFDLEQVKRSTYFFS

SEQ ID NO: 58508 - protein, 390 aa, Homo sapiens
MEDPTLYIVERPLPGYPDAEAPEPSSAGAQAAEEPSGAGSEELIKSDQVNGVLVLSLLDKIIGAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 58509 - protein, 345 aa, Homo sapiens
MEDPTLYIVERPLPGYPDAVDQIQLTQAQLEERQAEMEGAVQSIQGELSKLGKAHATTSNTVSKLLEKVRKVSVNVKTVRGSLERQAGQIKKLEVNEAELLRRRNFKVMIYQDEVKLPAKLSISKSLKESEALPEKEGEELGEGERPEEDAAALELSSDEAVEVEEVIEESRAERIKRSGLRRVDDFKKAFSKEKMEKTKVRTRENLEKTRLKTKENLEKTRHTLEKRMNKLGTRLVPAERREKLKTSRDKLRKSFTPDHVVYARSKTAVYKVPPFTFHVKKIREGQVEVLKATEMVEVGADDDEGGAERGEAGDLRRGSSPDVHALLEITEESDAVLVDKSDSD

SEQ ID NO: 58510 - protein, 764 aa, Homo sapiens
MLLFVLTCLLAVFPAISTKSPIFGPEEVNSVEGNSVSITCYYPPTSVNRHTRKYWCRQGARGGCITLISSEGYVSSKYAGRANLTNFPENGTFVVNIAQLSQDDSGRYKCGLGINSRGLSFDVSLEVSQGPGLLNDTKVYTVDLGRTVTINCPFKTENAQKRKSLYKQIGLYPVLVIDSSGYVNPNYTGRIRLDIQGTGQLLFSVVINQLRLSDAGQYLCQAGDDSNSNKKNADLQVLKPEPELVYEDLRGSVTFHCALGPEVANVAKFLCRQSSGENCDVVVNTLGKRAPAFEGRILLNPQDKDGSFSVVITGLRKEDAGRYLCGAHSDGQLQEGSPIQAWQLFVNEESTIPRSPTVVKGVAGGSVAVLCPYNRKESKSIKYWCLWEGAQNGRCPLLVDSEGWVKAQYEGRLSLLEEPGNGTFTVILNQLTSRDAGFYWCLTNGDTLWRTTVEIKIIEGEPNLKVPGNVTAVLGETLKVPCHFPCKFSSYEKYWCKWNNTGCQALPSQDEGPSKAFVNCDENSRLVSLTLNLVTRADEGWYWCGVKQGHFYGETAAVYVAVEERKAAGSRDVSLAKADAAPDEKVLDSGFREIENKAIQDPRLFAEEKAVADTRDQADGSRASVDSGSSEEQGGSSRALVSTLVPLGLVLAVGAVAVGVARARHRKNVDRVSIRSYRTDISMSDFENSREFGANDNMGASSITQETSLGGKEEFVATTESTTETKEPKKAKRSSKEEAEMAYKDFLLQSSTVAAEAQDGPQEA

SEQ ID NO: 58511 - protein, 531 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 58512 - protein, 197 aa, Homo sapiens
MDGIVPDIAVGTKRVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 58513 - protein, 557 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFGAPGIISASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 58514 - protein, 550 aa, Homo sapiens
MDGIVPDIAVGTKRGSDELFSTCVTNGPFIMSSNSASAANGNDSKKFKGDSRSAGVPSRVIHIRKLPIDVTEGEVISLGLPFGKVTNLLMLKGKNQAFIEMNTEEAANTMVNYYTSVTPVLRGQPIYIQFSNHKELKTDSSPNQARAQAALQAVNSVQSGNLALAASAAAVDAGMAMAGQSPVLRIIVENLFYPVTLDVLHQIFSKFGTVLKIITFTKNNQFQALLQYADPVSAQHAKLSLDGQNIYNACCTLRIDFSKLTSLNVKYNNDKSRDYTRPDLPSGDSQPSLDQTMAAAFASPYAGAGFPPTFAIPQAAGLSVPNVHGALAPLAIPSAAAAAAAAGRIAIPGLAGAGNSVLLVSNLNPERVTPQSLFILFGVYGDVQRVKILFNKKENALVQMADGNQAQLAMSHLNGHKLHGKPIRITLSKHQNVQLPREGQEDQGLTKDYGNSPLHRFKKPGSKNFQNIFPPSATLHLSNIPPSVSEEDLKVLFSSNGGVVKGFKFFQKDRKMALIQMGSVEEAVQALIDLHNHDLGENHHLRVSFSKSTI

SEQ ID NO: 58515 - protein, 532 aa, Homo sapiens
MDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQRDHKMALLQMATVEEAIQALIDLHNYNLGENHHLRVSFSKSTI

SEQ ID NO: 58516 - protein, 537 aa, Homo sapiens
MDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLGLPVAAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQRDHKMALLQMATVEEAIQALIDLHNYNLGENHHLRVSFSKSTI

SEQ ID NO: 58517 - protein, 536 aa, Homo sapiens
MDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLGLPVAAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQDHKMALLQMATVEEAIQALIDLHNYNLGENHHLRVSFSKSTI

SEQ ID NO: 58518 - protein, 351 aa, Homo sapiens
GMKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLGLPVAAVPGALSPLAIPNAAAAAAAAAAGRVGMPGVSAGGNTVLLVSNLNEEVFMEMCSV

SEQ ID NO: 58519 - protein, 548 aa, Homo sapiens
MWSNLTFSFFGLRTKAKKYVTVNNRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLGLPVAAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQRDHKMALLQMATVEEAIQALIDLHNYNLGENHHLRVSFSKSTI

SEQ ID NO: 58520 - protein, 531 aa, Homo sapiens
MDGIVTEVAVGVKRGSDELLSGSVLSSPNSNMSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLAVPGALSPLAIPNAAAAAAAAAAGRVGMPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQDHKMALLQMATVEEAIQALIDLHNYNLGENHHLRVSFSKSTI

SEQ ID NO: 58521 - protein, 325 aa, Homo sapiens
MSSMVVTANGNDSKKFKGEDKMDGAPSRVLHIRKLPGEVTETEVIALGLPFGKVTNILMLKGKNQAFLELATEEAAITMVNYYSAVTPHLRNQPIYIQYSNHKELKTDNTLNQRAQAVLQAVTAVQTANTPLSGTTVSESAVTPAQSPVLRIIIDNMYYPVTLDVLHQIFSKFGAVLKIITFTKNNQFQALLQYGDPVNAQQAKLALDGQNIYNACCTLRIDFSKLVNLNVKYNNDKSRDYTRPDLPSGDGQPALDPAIAAAFAKETSLLAVPGALSPLAIPNAAAAAAAAAAGRVGMPGVSAGGNTVLLVSNLNEEVFMEMCSV

SEQ ID NO: 58522 - protein, 204 aa, Homo sapiens
MPGVSAGGNTVLLVSNLNEEMVTPQSLFTLFGVYGDVQRVKILYNKKDSALIQMADGNQSQLAMNHLNGQKMYGKIIRVTLSKHQTVQLPREGLDDQGLTKDFGNSPLHRFKKPGSKNFQNIFPPSATLHLSNIPPSVAEEDLRTLFANTGGTVKAFKFFQRDHKMALLQMATVEEAIQALIDLHNYNLGENHHLRVSFSKSTI

SEQ ID NO: 58523 - protein, 115 aa, Homo sapiens
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNM

SEQ ID NO: 58524 - protein, 187 aa, Homo sapiens
MVCSPVTLRIAPPDRRFSRSAIPEQIISSTLSSPSSNAPDPCAKETVLSALKEKKKKRTVEEEDQIFLDGQENKRSCLVDGLTDASSAFKVPRPGPDTLQFTVDVFHFANDSRNMIYITCHLKVTLAEQDPDELNKACSFSKPSNSWFPVEGLADICQCCNKGDCGTPSHSRRQPRVVSQWSTSASL

SEQ ID NO: 58525 - protein, 364 aa, Homo sapiens
MSANSSRVGQLLLQGSACIRWKQDVEGAVYHLANCLLLLGFMGGSGVYGCFYLFGFLSAGYLCCVLWGWFSACGLDIVLWSFLLAVVCLLQLAHLVYRLREDTLPEEFDLLYKTLCLPLQVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILASRIPLQSYSQVISRGQAPLAPTHTPEL

SEQ ID NO: 58526 - protein, 360 aa, Homo sapiens
MSANSSRVGQLLLQGSACIRWKQDVEGAVYHLANCLLLLGFMGGSGVYGCFYLFGFLSAGYLCCVLWGWFSACGLDIVLWSFLLAVVCLLQLAHLVYRLREDTLPEEFDLLYKTLCLPLQVPLQTYKEIVHCCEEQVLTLATEQTYAVEGETPINRLSLLLSGRVRVSQDGQFLHYIFPYQFMDSPEWESLQPSEEGVFQVTLTAETSCSYISWPRKSLHLLLTKERYISCLFSALLGYDISEKLYTLNDKLFAKFGLRFDIRLPSLYHVLGPTAADAGPESEKGDEEVCEPAVSPPQATPTSLQQTPPCSTPPATTNFPAPPTRARLSRPDSGILEIDDFPSYFHQFGFSGKVAAGRIP

SEQ ID NO: 58527 - protein, 360 aa, Homo sapiens; identical to SEQ ID NO: 58526

SEQ ID NO: 58528 - protein, 291 aa, Homo sapiens
MERNSSLWKNLIDEHPVCTTWKQEAEGAIYHLASILFVVGFMGGSGFFGLLYVFSLLGLGFLCSAVWAWVDVCAADIFSWNFVLFVICFMQFVHIAYQVRSITFAREFQVLYSSLFQPLGISLPVFRTIALSSEVVTLEKEHCYAMQGKTSIDKLSLLVSGRIRVTVDGEFLHYIFPLQFLDSPEWDSLRPTEEGIFQVTLTAETDCRYVSWRRKKLYLLFAQHRYISRLFSVLIGSDIADKLYALNDRVYIGKRYHYDIRLPNFYQMSTPEIRRSPLTQHFQNSRRYCDK

SEQ ID NO: 58529 - protein, 101 aa, Homo sapiens
MLFLCFDRIRVTVDGEFLHYIFPLQFLDSPEWDSLRPTEEGIFQVTLTAETDCRYVSWRRKKLYLLFAQHRYISRLFSVLIGSDIADKLYALNDRVYIGKR

SEQ ID NO: 58530 - protein, 461 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 58531 - protein, 455 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKGTMVRWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 58532 - protein, 456 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRNKKRKARWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 58533 - protein, 455 aa, Homo sapiens; identical to SEQ ID NO: 58531

SEQ ID NO: 58534 - protein, 450 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 58535 - protein, 379 aa, Homo sapiens
MVWVVLLSLLCYLVLFLCRHSSHRGVFLSVTILIYLLMGEMHMVDTVTWHKMRGAQMIVAMKAVSLGFDLDRGEVGTVPSPVEFMGYLYFVGTIVFGPWISFHSYLQAVQGRPLSCRWLQKVARSLALALLCLVLSTCVGPYLFPYFIPLNGDRLLRKWLRAYESAVSFHFSNYFVGFLSEATATLAGAGFTEEKDHLEWDLTVSKPLNVELPRSMVEVVTSWNLPMSYWLNNYVFKNALRLGTFSAVLVTYAASALLHGFSFHLAAVLLSLAFITYVEHVLRKRLARILSACVLSKRCPPDCSHQHRLGLGVRALNLLFGALAIFHLAYLGSLFDVDVDDTTEEQGYGMAYTVHKWSELSWASHWVTFGCWIFYRLIG

SEQ ID NO: 58536 - protein, 97 aa, Homo sapiens
MATFSRQEFFQQLLQGCLLPTAQQGLDQIWLLLAICLACRLLWRLGLPSYLKHASTVAGGFFSLYHFFQLHMVWVVLLSLLCYLVLFLCRHSSHRGV

SEQ ID NO: 58537 - protein, 461 aa, Homo sapiens; identical to SEQ ID NO: 58530

SEQ ID NO: 58538 - protein, 922 aa, Homo sapiens
MFLHSVNLWNLAFYVFMVFLATLGLWDVFFGFEENKCSMSYMFEYPEYQKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVRFHGGALPAYVVSNILLAYRGQLYSLFSTGCCLEYATMLDKEAKPYKVDPFVIIIKFLLGYKWFKELWDVLLLPELDAVILTCQSMCFPLISLILFLFGTCTAYWSGLLSSASVRLLSSLWLALKRPSELPKDIKMISPDLPFLTIVLIIVSWTTCGALAILLSYLYYVFKVVHLQASLTTFKNSQPVNPKHSRRSEKKSNHHKDSSIHHLRLSANDAEDSLRMHSTVINLLTWIVLLSMPSLIYWLKNLRYYFKLNPDPCKPLAFILIPTMAILGNTYTVSIKSSKLLKTTSQFPLPLAVGVIAFGSAHLYRLPCFVFIPLLLHALCNFM

SEQ ID NO: 58539 - protein, 304 aa, Homo sapiens
MEVLESKKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGI

SEQ ID NO: 58540 - protein, 592 aa, Homo sapiens
MFLHSVNLWNLAFYVFMVFLATLGLWDVFFGFEENKCSMSYMFEYPEYQKIELPKKLAKRYPAYELYLYGEGSYAEEHKILPLTGIPVLFLPGNAGSYKQVRSIGSIALRKAEDIDFKYHFDFFSVNFNEELVALYGGSLQKQTKFVHECIKTILKLYKGQEFAPKSVAIIGHSMGGLVARALLTLKNFKHDLINLLITQATPHVAPVMPLDRFITDFYTTVNNYWILNARHINLTTLSVAGGFRDYQVRSGLTFLPKLSHHTSALSVVSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVA

SEQ ID NO: 58541 - protein, 430 aa, Homo sapiens
MFLHSVNLWNLAFYVFMVFLATLGLWDVFFGFEENKCSMSYMFEYPEYQSSAVPKTWVSTDHLSIVWCKQLQLTTVRAFFDLIDADTKQITQNSKKKLSVLYHHFIRHPSKHFEENPAIISDLTGTSMWVLVKVSKWTYVAYNESEKIYFTFPLENHRKIYTHVYCQSTMLDTNSWIFACINSTSMCLQGVDLSWKAELLPTIKYLTLRLQDYPSLSHLVVYVPSVRGSKFVVDCEFFKKEKRYIQLPVTHLFSFGLSSRKVVLNTNGLYYNLELLNFGQIYQAFKINVVSKCSAVKEEITSIYRLHIPWSYEDSLTIAQAPSSTEISLKLHIAQPENNTHVALFKMYTSSDCRYEVTVKTSFSQILGQVVRFHGGALPAYVVSNILLAYRGQLYSLFSTGCCLEYATMLDKEAKPYKVDPFVIIIKFLL

SEQ ID NO: 58542 - protein, 257 aa, Homo sapiens
MSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDRETGRFSRPCECLVVRVAPDLGERITLSGDKSLIEEVFPEIGDVMCNSVNAGWNHDSTHVIRFPLNGYCHLNSVQVLERLQQRGFEIVGSCGGGVDSSQFSEYVLRRELRRTPRVPSVIRIKQEPLD

SEQ ID NO: 58543 - protein, 257 aa, Homo sapiens; identical to SEQ ID NO: 58542

SEQ ID NO: 58544 - protein, 865 aa, Homo sapiens
MARMPGSGDCNTSAGGSASAAAAAAENNGERGEGERGAGGRGRRHSRPHYCSAGEEEEEEEEEDEIQEVQITGDEEEEEDGGGGLEEDEEEEEEEEMGLDWDEPLEPEDSAGEELEPEPVHMINMDQSAALEPEAPPRLLAPRARGGPPGDGSELDPDVLQRPERARLSENTRLATRYAVRIFREYLSEKAQSPDFETMDKGALCRVLRSFYAEARSKSGQLYSKSSLISIRSSLNRYLNEPPYCRTLDLTKDPELRSANLTLAAVIRKLEEQGAGPVVQKQAITRADLRKLYTSSVFSTNTPFGLLNKVWFETCMYFCTRGRENQRELEEDSFGLAMDEDGRKFVYFKSLGPYHKSRSSSWSKKRAESSDEENLPRMYETGTEFCPYASFVKYLSKRNPLCKAFFQRPRDHCSEGDVTWYENKAIGKNLLGTRMQMLSKAAKLSKTYTNHCIGAVSIATLNSIAGIGTKLGSPAPQGCYAEALNGAARHHSHHPPTHPSHHHRPQPPSLGNTYILPKDSQVGPDVKSEAAPKRALYESVFGSGEICGPTSPKRLCIRPSEPVDAVVVVSVKHDPLPLLPEANGHRSTNSPTIVSPAIVSPTQDSRPNMSRPLITRSPASPLNNQGIPTPAQLTKSNAPVHIDVGGHMYTSSLATLTKYPESRIGRLFDGTEPIVLDSLKQHYFIDRDGQMFRYILNFLRTSKLLIPDDFKDYTLLYEEAKYFQLQPMLLEMERWKQDRETGRFSRPCECLVVRVAPDLGERITLSGDKSLIEEVFPEIGDVMCNSVNAGWNHDSTHVIRFPLNGYCHLNSVQVLERLQQRGFEIVGSCGGGVDSSQFSEYVLRRELRRTPRVPSVIRIKQEPLD

SEQ ID NO: 58545 - protein, 257 aa, Homo sapiens; identical to SEQ ID NO: 58542

SEQ ID NO: 58546 - protein, 313 aa, Homo sapiens
MEEMSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQNKDTYEPFCKVPVITSSKEEQKLIATSNKPAVKLLYNRSNNKYSYTSNSDDNMLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 58547 - protein, 132 aa, Homo sapiens
MLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 58548 - protein, 279 aa, Homo sapiens
  MOD_RES (1)..(1): Any amino acid
XRYCRSPFWSGYGNFYSLQKSGFLPTLGTVQPFNYCKSGWILIDRCGKHFGTILNYLRDGAVPLPESRREIEELLAEAKYYLVQGLVEECQAALQNKDTYEPFCKVPVITSSKEEQKLIATSNKPAVKLLYNRSNNKYSYTSNSDDNMLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 58549 - protein, 287 aa, Homo sapiens
MSGESVVSSAVPAAATRTTSFKGTSPSSKYVKLNVGGALYYTTMQTLTKQDTMLKAMFSGRMEVLTDSEGWILIDRCGKHFGTILNYLRDGAVPLPESRREIEELLAEAKYYLVQGLVEECQAALQNKDTYEPFCKVPVITSSKEEQKLIATSNKPAVKLLYNRSNNKYSYTRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 58550 - protein, 155 aa, Homo sapiens
MMAVFTSLWSPYQMLFCSNSDDNMLKNIELFDKLSLRFNGRVLFIKDVIGDEICCWSFYGQGRKIAEVCCTSIVYATEKKQTKVEFPEARIYEETLNILLYEAQDGRGPDNALLEATGGAAGRSHHLDEDEERERIERVRRIHIKRPDDRAHLHQ

SEQ ID NO: 58551 - protein, 329 aa, Homo sapiens
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKVEFPEARIFEETLNILIYETPRGPDPALLEATGGAAGAGGAGRGEDEENREHRVRRIHVRRHITHDERPHGQQIVFKD

SEQ ID NO: 58552 - protein, 329 aa, Homo sapiens; identical to SEQ ID NO: 58551

SEQ ID NO: 58553 - protein, 428 aa, Homo sapiens
MALSGNCSRYYPREQGSAVPNSFPEVVELNVGGQVYFTRHSTLISIPHSLLWKMFSPKRDTANDLAKDSKGRFFIDRDGFLFRYILDYLRDRQVVLPDHFPEKGRLKREAEYFQLPDLVKLLTPDEIKQSPDEFCHSDFEDASQGSDTRICPPSSLLPADRKWGFITVGYRGSCTLGREGQADAKFRRVPRILVCGRISLAKEVFGETLNESRDPDRAPERYTSRFYLKFKHLERAFDMLSECGFHMVACNSSVTASFINQYTDDKIWSSYTEYVFYREPSRWSPSHCDCCCKNGKGDKEGESGTSCNDLSTSSCDSQSEASSPQETVICGPVTRQTNIQTLDRPIKKGPVQLIQQSEMRRKSDLLRTLTSGSRESNMSSKKKAVKEKLSIEEELEKCIQDFLKIKIPDRFPERKHPWQSELLRKYHL

SEQ ID NO: 58554 - protein, 428 aa, Homo sapiens; identical to SEQ ID NO: 58553

SEQ ID NO: 58555 - protein, 263 aa, Homo sapiens
MAELQLDPAMAGLGGGGGSGVGDGGGPVRGPPSPRPAGPTPRGHGRPAAAVAQPLEPGPGPPERAGGGGAARWVRLNVGGTYFVTTRQTLGREPKSFLCRLCCQEDPELDSDKDETGAYLIDRDPTYFGPILNYLRHGKLIITKELAEEGVLEEAEFYNIASLVRLVKERIRDNENRTSQGPVKHVYRVLQCQEEELTQMVSTMSDGWKFEQLISIGSSYNYGNEDQAEFLCVVSRELNNSTNGIVIEPSEKAKILQERGSRM

SEQ ID NO: 58556 - protein, 245 aa, Homo sapiens
SLPRNGPARLRAGSSGGGGGPRWRNCSWTRRWRGWEGAPGPGPPERAGGGGAARWVRLNVGGTYFVTTRQTLGREPKSFLCRLCCQEDPELDSDKDETGAYLIDRDPTYFGPILNYLRHGKLIITKELAEEGVLEEAEFYNIASLVRLVKERIRDNENRTSQGPVKHVYRVLQCQEEELTQMVSTMSDGWKFEQLISIGSSYNYGNEDQAEFLCVVSRELNNSTNGIVIEPSEKAKILQERGSRM

SEQ ID NO: 58557 - protein, 815 aa, Homo sapiens
MAGGHCGSFPAAAAGSGEIVQLNVGGTRFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRIKESSGWQQVFTSPYLDWTIERVALNAKVVGGPHGDKDKMVAVASESSIILWSVQDGGSGSEIGVFSLGVPVDALFFIGNQLVATSHTGKVGVWNAVTQHWQVQDVVPITSYDTAGSFLLLGCNNGSIYYIDMQKFPLRMKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKRICEIQAVDCTTISSFTVRECEGSSRMGSRPRRYLFTGHTNGSIQMWDLTTAMDMVNKSEDKDVGGPTEEELLKLLDQCDLSTSRCATPNISPATSVVQHSHLRESNSSLQLQHHDTTHEAATYGSMRPYRESPLLARARRTESFHSYRDFQTINLNRNVERAVPENGNLGPIQAEVKGATGECNISERKSPGVEIKSLRELDSGLEVHKIAEGFSESKKRSSEDENENKIEFRKKGGFEGGGFLGRKKVPYLASSPSTSDGGTDSPGTASPSPTKTTPSPRHKKSDSSGQEYSL

SEQ ID NO: 58558 - protein, 240 aa, Homo sapiens
MAGGHCGSFPAAAAGSGEIVQLNVGGTRFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRVFWLGTVGHACNPSTLGGRDGWSSRSARPTW

SEQ ID NO: 58559 - protein, 188 aa, Homo sapiens
MKDNDLLVTELYHDPSNDAITALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKSLCGVSLVSRSSQEPT

SEQ ID NO: 58560 - protein, 213 aa, Homo sapiens
  MOD_RES (1)..(1): Any amino acid
XFSTSRQTLMWIPDSFFSSLLSGRISTLRDETGAIFIDRDPAAFAPILNFLRTKELDLRGVSINVLRHEAEFYGITPLVRRLLLCEELERSSCGSVLFHGYLPPPGIPSRKINNTVRSADSRNGLNSTEGEARGNGTQPVLSGTGEETVRLGFPVDPRKVLIVAGHHNWIVAAYAHFAVCYRVFWLGTVGHACNPSTLGGRDGWSSRSARPTW

SEQ ID NO: 58561 - protein, 168 aa, Homo sapiens
  MOD_RES (1)..(1): Any amino acid
XALSVYLTPKTSVSGNWIEIAYGTSSGAVRVIVQHPETVGSGPQLFQTFTVHRSPVTKIMLSEKHLVSVCADNNHVRTWTVTRFRGMISTQPGSTPLASFKILSLEETESHGSYSSGNDIGPFGERDDQQVFIQKVVPITNKLFVRLSSTGKSLCGVSLVSRSSQEPT

SEQ ID NO: 58562 - protein, 289 aa, Homo sapiens
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQGLTVDHQCIGVCDKHLVNHYYCKRPIYEFKITWW

SEQ ID NO: 58563 - protein, 575 aa, Homo sapiens
VSRKKMSLKSERRGIHVDQSDLLCKKGCGYYGNPAWQGFCSKCWREEYHKARQKQIQEDWELAERVLLCYPGWSAMVQFQLTATSASWAQVILLLQPPNVLGLQALQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKERRFHHVGQAGLELLTSGDPPASASQSAGNTGVEPPHPAVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 58564 - protein, 531 aa, Homo sapiens
MSLKSERRGIHVDQSDLLCKKGCGYYGNPAWQGFCSKCWREEYHKARQKQIQEDWELAERVLLCYPGWSAMVQFQLTATSASWAQVILLLQPPNVLGLQALQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 58565 - protein, 491 aa, Homo sapiens
MSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 58566 - protein, 491 aa, Homo sapiens; identical to SEQ ID NO: 58565

SEQ ID NO: 58567 - protein, 407 aa, Homo sapiens
MSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKPPERVEKIMDQIEKYIMTRLYKYVFCPETTDDEKKDLAIQKRIRALRWVTPQMLCVPVNEDIPEVSDMVVKAITDIIEMDSKRVPRDKLACITKCSKHIFNAIKITKNEPASADDFLPTLIYIVLKGNPPRLQSNIQYITRFCNPSRLMTGEDGYYFTNLCCAVAFIEKLDAQSLNLSQEDFDRYMSGQTSPRKQEAESWSPDACLGVKQMYKNLDLLSQLNERQERIMNEAKKLEKDLIDWTDGIAREVQDIVEKYPLEIKPPNQPLAAIDSENVENDKLPPPLQPQVYAG

SEQ ID NO: 58568 - protein, 288 aa, Homo sapiens
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQGLTVDHQCIGVCDKHLVNHYYCKRPIYEFKITW

SEQ ID NO: 58569 - protein, 220 aa, Homo sapiens
MKGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 58570 - protein, 336 aa, Homo sapiens
MLQSLAGSSCVRLVERHRSAWCFGFLVLGYLLYLVFGAVVFSSVELPYEDLLRQELRKLKRRFLEEHECLSEQQLEQFLGRVLEASNYGVSVLSNASGNWNWDFTSALFFASTVLSTTGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVATQSSACVDGPANH

SEQ ID NO: 58571 - protein, 242 aa, Homo sapiens
VLRVLSPDLVRRLLNLAVRAFQVPKGESLNFPESTPGYGHTVPLSDGGKAFCIIYSVIGIPFTLLFLTAVVQRITVHVTRRPVLYFHIRWGFSKQVVAIVHAVLLGFVTVSCFFFIPAAVFSVLEDDWNFLESFYFCFISLSTIGLGDYVPGEGYNQKFRELYKIGITCYLLLGLIAMLVVLETFCELHELKKFRKMFYVKKDKDEDQVHIIEHDQLSFSSITDQAAGMKEDQKQNEPFVAT

SEQ ID NO: 58572 - protein, 543 aa, Homo sapiens
MEDGFKGDRTEGCRSDSVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 58573 - protein, 543 aa, Homo sapiens
MKFPIETPRKQVNWDPKVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 58574 - protein, 538 aa, Homo sapiens
MFFLYTDFFLSLVAVPAAAPVCQPKSATNGQPPAPAPTPTPRLSISSRATVVARMEGTSQGGLQTVMKWKTVVAIFVVVVVYLVTGGLVFRALEQPFESSQKNTIALEKAEFLRDHVCVSPQELETLIQHALDADNAGVSPIGNSSNNSSHWDLGSAFFFAGTVITTIGYGNIAPSTEGGKIFCILYAIFGIPLFGFLLAGIGDQLGTIFGKSIARVEKVFRKKQVSQTKIRVISTILFILAGCIVFVTIPAVIFKYIEGWTALESIYFVVVTLTTVGFGDFVAGGNAGINYREWYKPLVWFWILVGLAYFAAVLSMIGDWLRVLSKKTKEEVGEIKAHAAEWKANVTAEFRETRRRLSVEIHDKLQRAATIRSMERRRLGLDQRAHSLDMLSPEKRSVFAALDTGRFKASSQESINNRPNNLRLKGPEQLNKHGQGASEDNIINKFGSTSRLTKRKNKDLKKTLPEDVQKIYKTFRNYSLDEEKKEEETEKMCNSDNSSTAMLTDCIQQHAELENGMIPTDTKDREPENNSLLEDRN

SEQ ID NO: 58575 - protein, 430 aa, Homo sapiens
MSSRSPRPPPRRSRRRLPRPSCCCCCCRRSHLNEDTGRFVLLAALIGLYLVAGATVFSALESPGEAEARARWGATLRNFSAAHGVAEPELRAFLRHYEAALAAGVRADALRPRWDFPGAFYFVGTVVSTIGFGMTTPATVGGKAFLIAYGLFGCAGTILFFNLFLERIISLLAFIMRACRERQLRRSGLLPATFRRGSALSEADSLAGWKPSVYHVLLILGLFAVLLSCCASAMYTSVEGWDYVDSLYFCFVTFSTIGFGDLVSSQHAAYRNQGLYRLGNFLFILLGVCCIYSLFNVISILIKQVLNWMLRKLSCRCCARCCPAPGAPLARRNAITPGSRLRRRLAALGADPAARDSDAEGRRLSGELISMRDLTASNKVSLALLQKQLSETANGYPRSVCVNTRQNGFSGGVGALGIMNNRLAETSASR

SEQ ID NO: 58576 - protein, 408 aa, Homo sapiens
MAGRGFSWGPGHLNEDNARFLLLAALIVLYLLGGAAVFSALELAHERQAKQRWEERLANFSRGHNLSRDELRGFLRHYEEATRAGIRVDNVRPRWDFTGAFYFVGTVVSTIGFGMTTPATVGGKIFLIFYGLVGCSSTILFFNLFLERLITIIAYIMKSCHQRQLRRRGALPQESLKDAGQCEVDSLAGWKPSVYYVMLILCTASILISCCASAMYTPIEGWSYFDSLYFCFVAFSTIGFGDLVSSQNAHYESQGLYRFANFVFILMGVCCIYSLFNVISILIKQSLNWILRKMDSGCCPQCQRGLLRSRRNVVMPGSVRNRCNISIETDGVAESDTDGRRLSGEMISMKDLLAANKASLAILQKQLSEMANGCPHQTSTLARDNEFSGGVGAFAIMNNRLAETSGDR

SEQ ID NO: 58577 - protein, 330 aa, Homo sapiens
MRRPSVRAAGLVLCTLCYLLVGAAVFDALESEAESGRQRLLVQKRGALRRKFGFSAEDYRELERLALQAEPHRAGRQWKFPGSFYFAITVITTIEYGHAAPGTDSGKVFCMFYALLGIPLTLVTFQSLGERLNAVVRRLLLAAKCCLGLRWTCVSTENLVVAGLLACAATLALGAVAFSHFEGWTFFHAYYYCFITLTTIGFGDFVALQSGEALQRKLPYVAFSFLYILLGLTVIGAFLNLVVLRFLVASADWPERAARTPSPRPPGAPESRGLWLPRRPARSVGSASVFCHVHKLERCARDNLGFSPPSSPGVVRGGQAPRLGARWKSI

SEQ ID NO: 58578 - protein, 262 aa, Homo sapiens
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGLRQGCGAKAAPGRRPRRGSTAARGVQVTPQDFPISKKGLGS

SEQ ID NO: 58579 - protein, 309 aa, Homo sapiens
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGTDPSKHYISVYRSLAAIWILLGLAWLALILPLGPLLLHRCCQLWLLSLRQGCGAKAAPGRRPRRGSTAARGVQVTPQDFPISKKGLGS

SEQ ID NO: 58580 - protein, 322 aa, Homo sapiens
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGHPLNFITPSGLLPSQEPFQTPHGKPESQQIPGSFQKVSSMNVWPLSGMHSPGLAFPLPDCNIPDQERFRPLHPGAWKFWPLPLPSSNSKWAPMWLGSSAQV

SEQ ID NO: 58581 - protein, 294 aa, Homo sapiens
MPSAGLCSCWGGRVLPLLLAYVCYLLLGATIFQLLERQAEAQSRDQFQLEKLRFLENYTCLDQWAMEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGTDPSKHYISVYRSLAAIWILLGLAWLALILPLGPLLLHRCCQLWLLSRGLGVKDGAASDPSGLPRPQKIPISA

SEQ ID NO: 58582 - protein, 197 aa, Homo sapiens
MEQFVQVIMEAWVKGVNPKGNSTNPSNWDFGSSFFFAGTVVTTIGYGNLAPSTEAGQVFCVFYALLGIPLNVIFLNHLGTGLRAHLAAIERWEDRPRRSQVLQVLGLALFLTLGTLVILIFPPMVFSHVEGWSFSEGFYFAFITLSTIGFGDYVVGLRQGCGAKAAPGRRPRRGSTAARGVQVTPQDFPISKKGLGS

SEQ ID NO: 58583 - protein, 332 aa, Homo sapiens
MYRPRARAAPEGRVRGCAVPSTVLLLLAYLAYLALGTGVFWTLEGRAAQDSSRSFQRDKWELLQNFTCLDRPALDSLIRDVVQAYKNGASLLSNTTSMGRWELVGSFFFSVSTITTIGYGNLSPNTMAARLFCIFFALVGIPLNLVVLNRLGHLMQQGVNHWASRLGGTWQDPDKARWLAGSGALLSGLLLFLLLPPLLFSHMEGWSYTEGFYFAFITLSTVGFGDYVIGMNPSQRYPLWYKNMVSLWILFGMAWLALIIKLILSQLETPGRVCSCCHHSSKEDFKSQSWRQGPDREPESHSPQQGCYPEGPMGIIQHLEPSAHAAGCGKDS

SEQ ID NO: 58584 - protein, 271 aa, Homo sapiens
MYRPRARAAPEGRVRGCAVPSTVLLLLAYLAYLALGTGVFWTLEGRAAQDSSRSFQRDKWELLQNFTCLDRPALDSLIRDVVQAYKNGASLLSNTTSMGRWELVGSFFFSVSTITTIGYGNLSPNTMAARLFCIFFALVGIPLNLVVLNRLGHLMQQGVNHWASRLGGTWQDPDKARWLAGSGALLSGLLLFLLLPPLLFSHMEGWSYTEGFYFAFITLSTVGFGDYVIASCLISDTRKPNRDWQTLERTSKSSGGLLKYRFLAGHGGSHL

SEQ ID NO: 58585 - protein, 384 aa, Homo sapiens
MEVSGHPQARRCCPEALGKLFPGLCFLCFLVTYALVGAVVFSAIEDGQVLVAADDGEFEKFLEELCRILNCSETVVEDRKQDLQGHLQKVKPQWFNRTTHWSFLSSLFFCCTVFSTVGYGYIYPVTRLGKYLCMLYALFGIPLMFLVLTDTGDILATILSTSYNRFRKFPFFTRPLLSKWCPKSLFKKKPDPKPADEAVPQIIISAEELPGPKLGTCPSRPSCSMELFERSHALEKQNTLQLPPQAMERSNSCPELVLGRLSYSIISNLDEVGQQVERLDIPLPIIALIVFAYISCAAAILPFWETQLDFENAFYFCFVTLTTIGFGDTVLEHPNFFLFFSIYIIVGMEIVFIAFKLVQNRLIDIYKNVMLFFAKGKFYHLVKK

SEQ ID NO: 58586 - protein, 152 aa, Homo sapiens
MMNPRAKRDFYLAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQDLETSHHAQKAAKYSVSSMPYWEFPSLVFSWLELEIS

SEQ ID NO: 58587 - protein, 411 aa, Homo sapiens
MAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 58588 - protein, 422 aa, Homo sapiens
MMNPRAKRDFYLAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 58589 - protein, 426 aa, Homo sapiens
MLPSASRERPGYRAGVAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIKWNVSQTKIRIISTIIFILFGCVLFVALPAIIFKHIEGWSALDAIYFVVITLTTIGFGDYVAGGSDIEYLDFYKPVVWFWILVGLAYFAAVLSMIGDWLRVISKKTKEEVGEFRAHAAEWTANVTAEFKETRRRLSVEIYDKFQRATSIKRKLSAELAGNHNQELTPCRRTLSVNHLTSERDVLPPLLKTESIYLNGLTPHCAGEEIAVIENIK

SEQ ID NO: 58590 - protein, 228 aa, Homo sapiens
MMNPRAKRDFYLAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQQIVAAINAGIIPLGNTSNQISHWDLGSSFFFAGTVITTIGFGNISPRTEGGKIFCIIYALLGIPLFGFLLAGVGDQLGTIFGKGIAKVEDTFIVDPILNIWTSISLSCGSGSL

SEQ ID NO: 58591 - protein, 156 aa, Homo sapiens
MLPSASRERPGYRAGVAAPDLLDPKSAAQNSKPRLSFSTKPTVLASRVESDTTINVMKWKTVSTIFLVVVLYLIIGATVFKALEQPHEISQRTTIVIQKQTFISQHSCVNSTELDELIQDLETSHHAQKAAKYSVSSMPYWEFPSLVFSWLELEIS

SEQ ID NO: 58592 - protein, 152 aa, Homo sapiens; identical to SEQ ID NO: 58586

SEQ ID NO: 58593 - protein, 394 aa, Homo sapiens
MKRQNVRTLALIVCTFTYLLVGAAVFDALESEPELIERQRLELRQQELRARYNLSQGGYEELERVVLRLKPHKAGVQWRFAGSFYFAITVITTIGYGHAAPSTDGGKVFCMFYALLGIPLTLVMFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 58594 - protein, 271 aa, Homo sapiens
MFQSLGERINTLVRYLLHRAKKGLGMRRADVSMANMVLIGFFSCISTLCIGAAAFSHYEHWTFFQAYYYCFITLTTIGFGDYVALQKDQALQTQPQYVAFSFVYILTGLTVIGAFLNLVVLRFMTMNAEDEKRDAEHRALLTRNGQAGGGGGGGSAHTTDTASSTAAAGGGGFRNVYAEVLHFQSMCSCLWYKSREKLQYSIPMIIPRDLSTSDTCVEQSHSSPGGGGRYSDTPSRRCLCSGAPRSAISSVSTGLHSLSTFRGLMKRRSSV

SEQ ID NO: 58595 - protein, 393 aa, Homo sapiens
MRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 58596 - protein, 393 aa, Homo sapiens; identical to SEQ ID NO: 58595

SEQ ID NO: 58597 - protein, 393 aa, Homo sapiens; identical to SEQ ID NO: 58595

SEQ ID NO: 58598 - protein, 418 aa, Homo sapiens
TTAPQEPPARPLQAGSGAGPAPGRAMRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 58599 - protein, 455 aa, Homo sapiens
VHASVHTRVRGLWVPWRGRHAHGGRGCRGVCGECRWVTTAPQEPPARPLQAGSGAGPAPGRAMRSTTLLALLALVLLYLVSGALVFRALEQPHEQQAQRELGEVREKFLRAHPCVSDQELGLLIKEVADALGGGADPETNSTSNSSHSAWDLGSAFFFSGTIITTIGYGNVALRTDAGRLFCIFYALVGIPLFGILLAGVGDRLGSSLRHGIGHIEAIFLKWHVPPELVRVLSAMLFLLIGCLLFVLTPTFVFCYMEDWSKLEAIYFVIVTLTTVGFGDYVAGADPRQDSPAYQPLVWFWILLGLAYFASVLTTIGNWLRVVSRRTRAEMGGLTAQAASWTGTVTARVTQRAGPAAPPPEKEQPLLPPPPCPAQPLGRPRSPSPPEKAQPPSPPTASALDYPSENLAFIDESSDTQSERGCPLPRAPRGRRRPNPPRKPVRPRGPGRPRDKGVPV

SEQ ID NO: 58600 - protein, 499 aa, Homo sapiens
MVDRGPLLTSAIIFYLAIGAAIFEVLEEPHWKEAKKNYYTQKLHLLKEFPCLGQEGLDKILEVVSDAAGQGVAITGNQTFNNWNWPNAMIFAATVITTIGYGNVAPKTPAGRLFCVFYGLFGVPLCLTWISALGKFFGGRAKRLGQFLTKRGVSLRKAQITCTVIFIVWGVLVHLVIPPFVFMVTEGWNYIEGLYYSFITISTIGFGDFVAGVNPSANYHALYRYFVELWIYLGLAWLSLFVNWKVSMFVEVHKAIKKRRRRRKESFESSPHSRKALQVKGSTASKDVNIFSFLSKKEETYNDLIKQIGKKAMKTSGGGETGPGPGLGPQGGGLPALPPSLVPLVVYSKNRVPTLEEVSQTLRSKGHVSRSPDEEAVARAPEDSSPAPEVFMNQLDRISEECEPWDAQDYHPLIFQDASITFVNTEAGLSDEETSKSSLEDNLAGEESPQQGAEAKAPLNMGEFPSSSESTFTSTESELSVPYEQLMNEYNKANSPKGT

SEQ ID NO: 58601 - protein, 313 aa, Homo sapiens
MRRGALLAGALAAYAAYLVLGALLVARLEGPHEARLRAELETLRAQLLQRSPCVAAPALDAFVERVLAAGRLGRVVLANASGSANASDPAWDFASALFFASTLITTVGYGYTTPLTDAGKAFSIAFALLGVPTTMLLLTASAQRLSLLLTHVPLSWLSMRWGWDPRRAACWHLVALLGVVVTVCFLVPAVIFAHLEEAWSFLDAFYFCFISLSTIGLGDYVPGEAPGQPYRALYKVLVTVYLFLGLVAMVLVLQTFRHVSDLHGLTELILLPPPCPASFNADEDDRVDILGPQPESHQQLSASSHTDYASIPR

SEQ ID NO: 58602 - protein, 307 aa, Homo sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGYLLLGLLAMLLAVETFSELPQVRAMGKFFRPSGPVTAEDQGGILGQDELALSTLPPAAPASGQAPAC

SEQ ID NO: 58603 - protein, 252 aa, Homo sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGGGTSLQGTAWEG

SEQ ID NO: 58604 - protein, 257 aa, Homo sapiens
MGGLRPWSRYGLLVVAHLLALGLGAVVFQALEGPPACRLQAELRAELAAFQAEHRACLPPGALEELLGTALATQAHGVSTLGNSSEGRTWDLPSALLFAASILTTTGYGHMAPLSPGGKAFCMVYAALGLPASLALVATLRHCLLPVLSRPRAWVAVHWQLSPARAALLQAVALGLLVASSFVLLPALVLWGLQGDCSLLGAVYFCFSSLSTIGLEDLLPGRGRSLHPVIYHLGQLALLGKSSHLTACGGRGKRSLD

SEQ ID NO: 58605 - protein, 252 aa, Homo sapiens; identical to SEQ ID NO: 58603

SEQ ID NO: 58606 - protein, 28 aa, Homo sapiens
  MOD_RES (1)..(1): Any amino acid
XLHPVIYHLGQLALLGGGTSLQGTAWEG

SEQ ID NO: 58607 - protein, 374 aa, Homo sapiens
MKRQNVRTLSLIVCTFTYLLVGAAVFDALESDHEMREEEKLKAEEIRIKGKYNISSEDYRQLELVILQSEPHRAGVQWKFAGSFYFAITVITTIGYGHAAPGTDAGKAFCMFYAVLGIPLTLVMFQSLGERMNTFVRYLLKRIKKCCGMRNTDVSMENMVTVGFFSCMGTLCIGAAAFSQCEEWSFFHAYYYCFITLTTIGFGDYVALQTKGALQKKPLYVAFSFMYILVGLTVIGAFLNLVVLRFLTMNSEDERRDAEERASLAGNRNSMVIHIPEEPRPSRPRYKADVPDLQSVCSCTCYRSQDYGGRSVAPQNSFSAKLAPHYFHSISYKIEEISPSTLKNSLFPSPISSISPGLHSFTDHQRLMKRRKSV

SEQ ID NO: 58608 - protein, 374 aa, Homo sapiens; identical to SEQ ID NO: 58607

SEQ ID NO: 58609 - protein, 374 aa, Homo sapiens; identical to SEQ ID NO: 58607

SEQ ID NO: 58610 - protein, 1230 aa, Homo sapiens
MARAKLPRSPSEGKAGPGGAPAGAAAPEEPHGLSPLLPARGGGSVGSDVGQRLPVEDFSLDSSLSQVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSESQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 58611 - protein, 1256 aa, Homo sapiens
MPLPDGARTPGGVCREARGGGYTNRTFEFDDGQCAPRRPCAGDGALLDTAGFKMSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYEDVANLTASDVMNRVNLGYLQDEMNDHQNTLSYVLINPPPDTRLEPSDIVYLIRSDPLAHVASSSQSRKSSCSHKLSSCNPETRDETQL

SEQ ID NO: 58612 - protein, 1235 aa, Homo sapiens
MPLPDGARTPGGVCREARGGGYTNRTFEFDDGQCAPRRPCAGDGALLDTAGFKMSDLDSEVLPLPPRYRFRDLLLGDPSFQNDDRVQVEFYVNENTFKERLKLFFIKNQRSSLRIRLFNFSLKLLTCLLYIVRVLLDDPALGIGCWGCPKQNYSFNDSSSEINWAPILWVERKMTLWAIQVIVAIISFLETMLLIYLSYKGNIWEQIFRVSFVLEMINTLPFIITIFWPPLRNLFIPVFLNCWLAKHALENMINDFHRAILRTQSAMFNQVLILFCTLLCLVFTGTCGIQHLERAGENLSLLTSFYFCIVTFSTVGYGDVTPKIWPSQLLVVIMICVALVVLPLQFEELVYLWMERQKSGGNYSRHRAQTEKHVVLCVSSLKIDLLMDFLNEFYAHPRLQDYYVVILCPTEMDVQVRRVLQIPLWSQRVIYLQGSALKDQDLMRAKMDNGEACFILSSRNEVDRTAADHQTILRAWAVKDFAPNCPLYVQILKPENKFHVKFADHVVCEEECKYAMLALNCICPATSTLITLLVHTSRGQEGQESPEQWQRMYGRCSGNEVYHIRMGDSKFFREYEGKSFTYAAFHAHKKYGVCLIGLKREDNKSILLNPGPRHILAASDTCFYINITKEENSAFIFKQEEKRKKRAFSGQGLHEGPARLPVHSIIASMGTVAMDLQGTEHRPTQSGGGGGGSKLALPTENGSGSRRPSIAPVLELADSSALLPCDLLSDQSEDEVTPSDDEGLSVVEYVKGYPPNSPYIGSSPTLCHLLPVKAPFCCLRLDKGCKHNSYEDAKAYGFKNKLIIVSAETAGNGLYNFIVPLRAYYRSRKELNPIVLLLDNKPDHHFLEAICCFPMVYYMEGSVDNLDSLLQCGIIYADNLVVVDKESTMSAEEDYMADAKTIVNVQTMFRLFPSLSITTELTHPSNMRFMQFRAKDSYSLALSKLEKRERENGSNLAFMFRLPFAAGRVFSISMLDTLLYQSFVKDYMITITRLLLGLDTTPGSGYLCAMKITEGDLWIRTYGRLFQKLCSSSAEIPIGIYRTESHVFSTSEPHDLRAQSQISVNVEDCEDTREVKGPWGSRAGTGGSSQGRHTGGGDPAEHPLLRRKSLQWARRLSRKAPKQAGRAAAAEWISQQRLSLYRRSERQELSELVKNRMKHLGLPTTGYDEMNDHQNTLSYVLINPPPDTRLEPSDIVYLIRSDPLAHVASSSQSRKSSCSHKLSSCNPETRDETQL

SEQ ID NO: 58613 - protein, 1135 aa, Homo sapiens
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPPDMHFLDAICWFPMVYYMVGSIDNLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 58614 - protein, 1069 aa, Homo sapiens
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSEETYILIFLSQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 58615 - protein, 1111 aa, Homo sapiens
MVDLESEVPPLPPRYRFRDLLLGDQGWQNDDRVQVEFYMNENTFKERLKLFFIKNQRSSLRIRLFNFSLKLLSCLLYIIRVLLENPSQGNEWSHIFWVNRSLPLWGLQVSVALISLFETILLGYLSYKGNIWEQILRIPFILEIINAVPFIISIFWPSLRNLFVPVFLNCWLAKHALENMINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNPLDDLLRCGVTFAANMVVVDKESTMSAEEDYMADAKTIVNVQTLFRLFSSLSIITELTHPANMRFMQFRAKDCYSLALSKLEKKERERGSNLAFMFRLPFAAGRVFSISMLDTLLYQSFVKDYMISITRLLLGLDTTPGSGFLCSMKITADDLWIRTYARLYQKLCSSTGDVPIGIYRTESQKLTTSESQISISVEEWEDTKDSKEQGHHRSNHRNSTSSDQSDHPLLRRKSMQWARRLSRKGPKHSGKTAEKITQQRLNLYRRSERQELAELVKNRMKHLGLSTVGYDEMNDHQSTLSYILINPSPDTRIELNDVVYLIRPDPLAYLPNSEPSRRNSICNVTGQDSREETQL

SEQ ID NO: 58616 - protein, 370 aa, Homo sapiens
MPYLHLDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKSCQHNYYEDAKAYGFKNKLIIVAAETAGNGLYNFIVPLRAYYRPKKELNPIVLLLDNP

SEQ ID NO: 58617 - protein, 523 aa, Homo sapiens
IINDLHRAIQRTQSAMFNQVLILISTLLCLIFTCICGIQHLERIGKKLNLFDSLYFCIVTFSTVGFGDVTPETWSSKLFVVAMICVALVVLPIQFEQLAYLWMERQKSGGNYSRHRAQTEKHVVLCVSSLKIDLLMDFLNEFYAHPRLQDYYVVILCPTEMDVQVRRVLQIPMWSQRVIYLQGSALKDQDLLRAKMDDAEACFILSSRCEVDRTSSDHQTILRAWAVKDFAPNCPLYVQILKPENKFHIKFADHVVCEEEFKYAMLALNCICPATSTLITLLVHTSRGQEGQQSPEQWQKMYGRCSGNEVYHIVLEESTFFAEYEGKSFTYASFHAHKKFGVCLIGVRREDNKNILLNPGPRYIMNSTDICFYINITKEENSAFKNQDQQRKSNVSRSFYHGPSRLPVHSIIASMGTVAIDLQDTSCRSASGPTLSLPTEGSKEIRRPSIAPVLEVADTSSIQTCDLLSDQSEDETTPDEEMSSNLEYAKGYPPYSPYIGSSPTFCHLLHEKVPFCCLRLDKF

SEQ ID NO: 58618 - protein, 500 aa, Homo sapiens
MPSSGRALLDSPLDSGSLTSLDSSVFCSEGEGEPLALGDCFTVNVGGSRFVLSQQALSCFPHTRLGKLAVVVASYRRPGALAAVPSPLELCDDANPVDNEYFFDRSSQAFRYVLHYYRTGRLHVMEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 58619 - protein, 500 aa, Homo sapiens; identical to SEQ ID NO: 58618

SEQ ID NO: 58620 - protein, 376 aa, Homo sapiens
MEQLCALSFLQEIQYWGIDELSIDSCCRDRYFRRKELSETLDFKKDTEDQESQHESEQDFSQGPCPTVRQKLWNILEKPGSSTAARIFGVISIIFVVVSIINMALMSAELSWLDLQLLEILEYVCISWFTGEFVLRFLCVRDRCRFLRKVPNIIDLLAILPFYITLLVESLSGSQTTQELENVGRIVQVLRLLRALRMLKLGRHSTGLRSLGMTITQCYEEVGLLLLFLSVGISIFSTVEYFAEQSIPDTTFTSVPCAWWWATTSMTTVGYGDIRPDTTTGKIVAFMCILSGILVLALPIAIINDRFSACYFTLKLKEAAVRQREALKKLTKNIATDSYISVNLRDVYARSIMEMLRLKGRERASTRSSGGDDFWF

SEQ ID NO: 58621 - protein, 545 aa, Homo sapiens
MLKQSERRRSWSYRPWNTTENEGSQHRRSICSLGARSGSQASIHGWTEGNYNYYIEEDEDGEEEDQWKDDLAEEDQQAGEVTTAKPEGPSDPPALLSTLNVNVGGHSYQLDYCELAGFPKTRLGRLATSTSRSRQLSLCDDYEEQTDEYFFDRDPAVFQLVYNFYLSGVLLVLDGLCPRRFLEELGYWGVRLKYTPRCCRICFEERRDELSERLKIQHELRAQAQVEEAEELFRDMRFYGPQRRRLWNLMEKPFSSVAAKAIGVASSTFVLVSVVALALNTVEEMQQHSGQGEGGPDLRPILEHVEMLCMGFFTLEYLLRLASTPDLRRFARSALNLVDLVAILPLYLQLLLECFTGEGHQRGQTVGSVGKVGQVLRVMRLMRIFRILKLARHSTGLRAFGFTLRQCYQQVGCLLLFIAMGIFTFSAAVYSVEHDVPSTNFTTIPHSWWWAAVSISTVGYGDMYPETHLGRFFAFLCIAFGIILNGMPISILYNKFSDYYSKLKAYEYTTIRRERGEVNFMQRARKKIAECLLGSNPQLTPRQEN

SEQ ID NO: 58622 - protein, 320 aa, Homo sapiens
MLKQSERRRSWSYRPWNTTENEGSQHRRSICSLGARSGSQASIHGWTEGNYNYYIEEDEDGEEEDQWKDDLAEEDQQAGEVTTAKPEGPSDPPALLSTLNVNVGGHSYQLDYCELAGFPKTRLGRLATSTSRSRQLSLCDDYEEQTDEYFFDRDPAVFQLVYNFYLSGVLLVLDGLCPRRFLEELGYWGVRLKYTPRCCRICFEERRDELSERLKIQHLRARLRGGAGAQHRGGDAAALGAGRGRPRPAAHPGARGDAVHGLLHARVPAAPSLHARPEALRAQRPQPGGPGGHPAALPSAAARVLHGRGPPTRPDGGQRG

SEQ ID NO: 58623 - protein, 579 aa, Homo sapiens
MSSCRYNGGVMRPLSNLSASRRNLHEMDSEAQPLQPPASVGGGGGASSPSAAAAAAAAVSSSAPEIVVSKPEHNNSNNLALYGTGGGGSTGGGGGGGGSGHGSSSGTKSSKKKNQNIGYKLGHRRALFEKRKRLSDYALIFGMFGIVVMVIETELSWGAYDKASLYSLALKCLISLSTIILLGLIIVYHAREIQLFMVDNGADDWRIAMTYERIFFICLEILVCAIHPIPGNYTFTWTARLAFSYAPSTTTADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 58624 - protein, 231 aa, Homo sapiens
MWLISITFLSIGYGDMVPNTYCGKGVCLLTGIMGAGCTALVVAVVARKLELTKAEKHVHNFMMDTQLTKRVKNAAANVLRETWLIYKNTKLVKKIDHAKVRKHQRKFLQAIHQLRSVKMEQRKLNDQANTLVDLAKTQNIMYDMISDLNERSEDFEKRIVTLETKLETLIGSIHALPGLISQTIRQQQRDFIEAQMESYDKHVTYNAERSRSSSRRRRSSSTAPPTSSESS

SEQ ID NO: 58625 - protein, 441 aa, Homo sapiens
MSSCRYNGGVMRPLSNLSASRRNLHEMDSEAQPLQPPASVGGGGGASSPSAAAAAAAAVSSSAPEIVVSKPEHNNSNNLALYGTGGGGSTGGGGGGGGSGHGSSSGTKSSKKKNQNIGYKLGHRRALFEKRKRLSDYALIFGMFGIVVMVIETELSWGAYDKASLYSLALKCLISLSTIILLGLIIVYHAREIQLFMVDNGADDWRIAMTYERIFFICLEILVCAIHPIPGNYTFTWTARLAFSYAPSTTTADVDIILSIPMFLRLYLIARVMLLHSKLFTDASSRSIGALNKINFNTRFVMKTLMTICPGTVLLVFSISLWIIAAWTVRACERYHDQQDVTSNFLGAMWLISITFLSIGYGDMVPNTYCGKGVCLLTGIMGAGCTALVVAVVARKLELTKAEKHVHNFMMDTQLTKRVSYYPYIFKENIIVIFSVLGNMA

SEQ ID NO: 58626 - protein, 731 aa, Homo sapiens
MDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRAPPSSNSTAILHPSSRQGSQLNLNDHLLGHSPSSTATSGPGGGSRHRQASPLVHRRDSNPFTEIAMSSCKYSGGVMKPLSRLSASRRNLIEAETEGQPLQLFSPSNPPEIVISSREDNHAHQTLLHHPNATHNHQHAGTTASSTTFPKANKRKNQNIGYKLGHRRALFEKRKRLSDYALIFGMFGIVVMVIETELSWGLYSKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 58627 - protein, 418 aa, Homo sapiens
MFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 58628 - protein, 426 aa, Homo sapiens
MERPIKDSMFSLALKCLISLSTIILLGLIIAYHTREVQLFVIDNGADDWRIAMTYERILYISLEMLVCAIHPIPGEYKFFWTARLAFSYTPSRAEADVDIILSIPMFLRLYLIARVMLLHSKLFTDASSRSIGALNKINFNTRFVMKTLMTICPGTVLLVFSISLWIIAAWTVRVCERYHDQQDVTSNFLGAMWLISITFLSIGYGDMVPHTYCGKGVCLLTGIMGAGCTALVVAVVARKLELTKAEKHVHNFMMDTQLTKRIKNAAANVLRETWLIYKHTKLLKKIDHAKVRKHQRKFLQAIHQLRSVKMEQRKLSDQANTLVDLSKMQNVMYDLITELNDRSEDLEKQIGSLESKLEHLTASFNSLPLLIADTLRQQQQQLLSAIIEARGVSVAVGTTHTPISDSPIGVSSTSFPTPYTSSSSC

SEQ ID NO: 58629 - protein, 227 aa, Homo sapiens
PHTLLEDHLLREFFHPLFFLQAPLLLSLPAQYNAFLSGSVWTPGSPREPKQAKERTGAKILVGEIGCLAFFEDIFGARVALGWGLVLQGIQPGPKMDTSGHFHDSGVGDLDEDPKCPCPSSGDEQQQQQQQQQQQQPPPPAPPAAPQQPLGPSLQPQPPQLQQQQQQQQQQQQQQPPHPLSQLAQLQSQPVHPGLLHSSPTAFRPPFVQLHRHPPPFLQARQPAQSQ

SEQ ID NO: 58630 - protein, 427 aa, Homo sapiens
MGGDLVLGLGALRRRKRLLEQEKSLAGWALVLAGTGIGLMVLHAEMLWFGGCSWALYLFLVKCTISISTFLLLCLIVAFHAKEVQLFMTDNGLRDWRVALTGRQAAQIVLELVVCGLHPAPVRGPPCVQDLGAPLTSPQPWPGFLGQGEALLSLAMLLRLYLVPRAVLLRSGVLLNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 58631 - protein, 295 aa, Homo sapiens
MHDQHFHLLTPLPHRGLSCQRGPAVHDRQRAAGLARGADRAAGNASYRSIGALNQVRFRHWFVAKLYMNTHPGRLLLGLTLGLWLTTAWVLSVAERQAVNATGHLSDTLWLIPITFLTIGYGDVVPGTMWGKIVCLCTGVMGVCCTALLVAVVARKLEFNKAEKHVHNFMMDIQYTKEMKESAARVLQEAWMFYKHTRRKESHAARRHQRKLLAAINAFRQVRLKHRKLREQVNSMVDISKMHMILYDLQQNLSSSHRALEKQIDTLAGKLDALTELLSTALGPRQLPEPSQQSK

SEQ ID NO: 58632 - protein, 372 aa, Homo sapiens
MFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 58633 - protein, 372 aa, Homo sapiens; identical to SEQ ID NO: 58632

SEQ ID NO: 58634 - protein, 303 aa, Homo sapiens
MAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPMENGVGGNSIFLVAPLIIYHVIDANSPLYDLAPSDLHHHQDLEIIVILEGVVETTGITTQARTSYLADEILWGQRFVPIVAEEDGRYSVDYSKFGNTVKVPTPLCTARQLDEDHSLLEALTLASARGPLRKRSVPMAKAKPKFSISPDSLS

SEQ ID NO: 58635 - protein, 433 aa, Homo sapiens
MTAASRANPYSIVSSEEDGLHLVTMSGANGFGNGKVHTRRRCRNRFVKKNGQCNIEFANMDEKSQRYLADMFTTCVDIRWRYMLLIFSLAFLASWLLFGIIFWVIAVAHGDLEPAEGRGRTPCVMQVHGFMAAFLFSIETQTTIGYGLRCVTEECPVAVFMVVAQSIVGCIIDSFMIGAIMAKMARPKKRAQTLLFSHNAVVALRDGKLCLMWRVGNLRKSHIVEAHVRAQLIKPRVTEEGEYIPLDQIDIDVGFDKGLDRIFLVSPITILHEIDEASPLFGISRQDLETDDFEIVVILEGMVEATAMTTQARSSYLANEILWGHRFEPVLFEEKNQYKIDYSHFHKTYEVPSTPRCSAKDLVENKFLLPSANSFCYENELAFLSRDEEDEADGDQDGRSRDGLSPQARHDFDRLQAGGGVLEQRPYRRESEI

SEQ ID NO: 58636 - protein, 418 aa, Homo sapiens
MSYYGSSYHIINADAKYPGYPPEHIIAEKRRARRRLLHKDGSCNVYFKHIFGEWGSYVVDIFTTLVDTKWRHMFVIFSLSYILSWLIFGSVFWLIAFHHGDLLNDPDITPCVDNVHSFTGAFLFSLETQTTIGYGYRCVTEECSVAVLMVILQSILSCIINTFIIGAALAKMATARKRAQTIRFSYFALIGMRDGKLCLMWRIGDFRPNHVVEGTVRAQLLRYTEDSEGRMTMAFKDLKLVNDQIILVTPVTIVHEIDHESPLYALDRKAVAKDNFEILVTFIYTGDSTGTSHQSRSSYVPREILWGHRFNDVLEVKRKYYKVNCLQFEGSVEVYAPFCSAKQLDWKDQQLHIEKAPPVRESCTSDTKARRRSFSAVAIVSSCENPEETTTSATHEYRETPYQKALLTLNRISVESQM

SEQ ID NO: 58637 - protein, 372 aa, Homo sapiens; identical to SEQ ID NO: 58632

SEQ ID NO: 58638 - protein, 391 aa, Homo sapiens
MNASSRNVFDTLIRVLTESMFKHLRKWVVTRFFGHSRQRARLVSKDGRCNIEFGNVEAQSRFIFFVDIWTTVLDLKWRYKMTIFITAFLGSWFFFGLLWYAVAYIHKDLPEFHPSANHTPCVENINGLTSAFLFSLETQVTIGYGFRCVTEQCATAIFLLIFQSILGVIINSFMCGAILAKISRPKKRAKTITFSKNAVISKRGGKLCLLIRVANLRKSLLIGSHIYGKLLKTTVTPEGETIILDQININFVVDAGNENLFFISPLTIYHVIDHNSPFFHMAAETLLQQDFELVVFLDGTVESTSATCQVRTSYVPEEVLWGYRFAPIVSKTKEGKYRVDFHNFSKTVEVETPHCAMCLYNEKDVRARMKRGYDNPNFILSEVNETDDTKM

SEQ ID NO: 58639 - protein, 372 aa, Homo sapiens; identical to SEQ ID NO: 58632

SEQ ID NO: 58640 - protein, 379 aa, Homo sapiens
MTSVAKVYYSQTTQTESRPLMGPGIRRRRVLTKDGRSNVRMEHIADKRFLYLKDLWTTFIDMQWRYKLLLFSATFAGTWFLFGVVWYLVAVAHGDLLELDPPANHTPCVVQVHTLTGAFLFSLESQTTIGYGFRYISEECPLAIVLLIAQLVLTTILEIFITGTFLAKIARPKKRAETIRFSQHAVVASHNGKPCLMIRVANMRKSLLIGCQVTGKLLQTHQTKEGENIRLNQVNVTFQVDTASDSPFLILPLTFYHVVDETSPLKDLPLRSGEGDFELVLILSGTVESTSATCQVRTSYLPEEILWGYEFTPAISLSASGKYIADFSLFDQVVKVASPSGLRDSTVRYGDPEKLKLEESLREQAEKEGSALSVRISNV

SEQ ID NO: 58641 - protein, 390 aa, Homo sapiens
MLSRKGIIPEEYVLTRLAEDPAKPRYRARQRRARFVSKKGNCNVAHKNIREQGRFLQDVFTTLVDLKWPHTLLIFTMSFLCSWLLFAMAWWLIAFAHGDLAPSEGTAEPCVTSIHSFSSAFLFSIEVQVTIGFGGRMVTEECPLAILILIVQNIVGLMINAIMLGCIFMKTAQAHRRAETLIFSKHAVIALRHGRLCFMLRVGDLRKSMIISATIHMQVVRKTTSPEGEVVPLHQVDIPMENGVGGNSIFLVAPLIIYHVIDANSPLYDLAPSDLHHHQDLEIIVILEGVVETTGITTQARTSYLADEILWGQRFVPIVAEEDGRYSVDYSKFGNTVKVPTPLCTARQLDEDHSLLEALTLASARGPLRKRSVPMAKAKPKFSISPDSLS

SEQ ID NO: 58642 - protein, 433 aa, Homo sapiens; identical to SEQ ID NO: 58635

SEQ ID NO: 58643 - protein, 360 aa, Homo sapiens
MDSSNCKVIAPLLSQRYRRMVTKDGHSTLQMDGAQRGLAYLRDAWGILMDMRWRWMMLVFSASFVVHWLVFAVLWYVLAEMNGDLELDHDAPPENHTICVKYITSFTAAFSFSLETQLTIGYGTMFPSGDCPSAIALLAIQMLLGLMLEAFITGAFVAKIARPKNRAFSIRFTDTAVVAHMDGKPNLIFQVANTRPSPLTSVRVSAVLYQERENGKLYQTSVDFHLDGISSDECPFFIFPLTYYHSITPSSPLATLLQHENPSHFELVVFLSAMQEGTGEICQRRTSYLPSEIMLHHCFASLLTRGSKGEYQIKMENFDKTVPEFPTPLVSKSPNRTDLDIHINGQSIDNFQISETGLTE

SEQ ID NO: 58644 - protein, 94 aa, Homo sapiens
MDSSNCKVIAPLLSQRYRRMVTKDGHSTLQMDGAQRGLAYLRDAWGILMDMRWRWMMLVFSASFVVHWLVFAVLWCFCGEDCPAKKSSFFNSLY

SEQ ID NO: 58645 - protein, 360 aa, Homo sapiens; identical to SEQ ID NO: 58643

SEQ ID NO: 58646 - protein, 375 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSESPFLILPMTFYHVLDETSPLRDLTPQNLKEKEFELVVLLNATVESTSAVCQSRTSYIPEEIYWGFEFVPVVSLSKNGKYVADFSQFEQIRKSPDCTFYCADSEKQQLEEKYRQEDQRERELRTLLLQQSNV

SEQ ID NO: 58647 - protein, 61 aa, Homo sapiens
MDAIHIGMSSTPLVKHTAGAGLKANRPRVMSKSGHSNVRIDKVDGIYLLYLQDLWTTVIDM

SEQ ID NO: 58648 - protein, 156 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLI

SEQ ID NO: 58649 - protein, 156 aa, Homo sapiens; identical to SEQ ID NO: 58648

SEQ ID NO: 58650 - protein, 375 aa, Homo sapiens; identical to SEQ ID NO: 58646

SEQ ID NO: 58651 - protein, 375 aa, Homo sapiens; identical to SEQ ID NO: 58646

SEQ ID NO: 58652 - protein, 375 aa, Homo sapiens; identical to SEQ ID NO: 58646

SEQ ID NO: 58653 - protein, 375 aa, Homo sapiens; identical to SEQ ID NO: 58646

SEQ ID NO: 58654 - protein, 19 aa, Homo sapiens
MDAIHIGMSSTPLVKHTAG

SEQ ID NO: 58655 - protein, 139 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEEC

SEQ ID NO: 58656 - protein, 245 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSES

SEQ ID NO: 58657 - protein, 39 aa, Homo sapiens
MDAIHIGMSSTPLVKHTAGAGLKANRPRVMSKSGHSNVR

SEQ ID NO: 58658 - protein, 48 aa, Homo sapiens
MDAIHIGMSSTPLVKHTAGAGLKANRPRVMSKSGHSNVRIDKVDGIYL

SEQ ID NO: 58659 - protein, 48 aa, Homo sapiens; identical to SEQ ID NO: 58658

SEQ ID NO: 58660 - protein, 48 aa, Homo sapiens; identical to SEQ ID NO: 58658

SEQ ID NO: 58661 - protein, 25 aa, Homo sapiens
MDAIHIGMSSTPLVKHTAGAGLKAN

SEQ ID NO: 58662 - protein, 48 aa, Homo sapiens; identical to SEQ ID NO: 58658

SEQ ID NO: 58663 - protein, 48 aa, Homo sapiens; identical to SEQ ID NO: 58658

SEQ ID NO: 58664 - protein, 48 aa, Homo sapiens; identical to SEQ ID NO: 58658

SEQ ID NO: 58665 - protein, 418 aa, Homo sapiens; identical to SEQ ID NO: 58636

SEQ ID NO: 58666 - protein, 418 aa, Homo sapiens; identical to SEQ ID NO: 58636

SEQ ID NO: 58667 - protein, 418 aa, Homo sapiens; identical to SEQ ID NO: 58636

SEQ ID NO: 58668 - protein, 427 aa, Homo sapiens
MGSVRTNRYSIVSSEEDGMKLATMAVANGFGNGKSKVHTRQQCRSRFVKKDGHCNVQFINVGEKGQRYLADIFTTCVDIRWRWMLVIFCLAFVLSWLFFGCVFWLIALLHGDLDASKEGKACVSEVNSFTAAFLFSIETQTTIGYGFRCVTDECPIAVFMVVFQSIVGCIIDAFIIGAVMAKMAKPKKRNETLVFSHNAVIAMRDGKLCLMWRVGNLRKSHLVEAHVRAQLLKSRITSEGEYIPLDQIDINVGFDSGIDRIFLVSPITIVHEIDEDSPLYDLSKQDIDNADFEIVVILEGMVEATAMTTQCRSSYLANEILWGHRYEPVLFEEKHYYKVDYSRFHKTYEVPNTPLCSARDLAEKKYILSNANSFCYENEVALTSKEEDDSENGVPESTSTDTPPDIDLHNQASVPLEPRPLRRESEI

SEQ ID NO: 58669 - protein, 427 aa, Homo sapiens; identical to SEQ ID NO: 58668

SEQ ID NO: 58670 - protein, 501 aa, Homo sapiens
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKSRQTPEGEFLPLDQLELDVGFSTGADQLFLVSPLTICHVIDAKSPFYDLSQRSMQTEQFEIVVILEGIVETTGMTCQARTSYTEDEVLWGHRFFPVISLEEGFFKVDYSQFHATFEVPTPPYSVKEQEEMLLMSSPLIAPAITNSKERHNSVECLDGLDDITTKLPSKLQKITGREDFPKKLLRMSSTTSEKAYSLGDLPMKLQRISSVPGNSEEKLVSKTTKMLSDPMSQSVADLPPKLQKMAGGAARMEGNLPAKLRKMNSDRFT

SEQ ID NO: 58671 - protein, 235 aa, Homo sapiens
MSALRRKFGDDYQVVTTSSSGSGLQPQGPGQDPQQQLVPKKKRQRFVDKNGRCNVQHGNLGSETSRYLSDLFTTLVDLKWRWNLFIFILTYTVAWLFMASMWWVIAYTRGDLNKAHVGNYTPCVANVYNFPSAFLFFIETEATIGYGYRYITDKCPEGIILFLFQSILGSIVDAFLIGCMFIKMSQPKKRAETLMFSEHAVISMRDGKLTLMFRVGNLRNSHMVSAQIRCKLLKG

SEQ ID NO: 58672 - protein, 445 aa, Homo sapiens
MHGHSRNGQAHVPRRKRRNRFVKKNGQCNVYFANLSNKSQRYMADIFTTCVDTRWRYMLMIFSAAFLVSWLFFGLLFWCIAFFHGDLEASPGVPAAGGPAAGGGGAAPVAPKPCIMHVNGFLGAFLFSVETQTTIGYGFRCVTEECPLAVIAVVVQSIVGCVIDSFMIGTIMAKMARPKKRAQTLLFSHHAVISVRDGKLCLMWRVGNLRKSHIVEAHVRAQLIKPYMTQEGEYLPLDQRDLNVGYDIGLDRIFLVSPIIIVHEIDEDSPLYGMGKEELESEDFEIVVILEGMVEATAMTTQARSSYLASEILWGHRFEPVVFEEKSHYKVDYSRFHKTYEVAGTPCCSARELQESKITVLPAPPPPPSAFCYENELALMSQEEEEMEEEAAAAAAVAAGLGLEAGSKEEAGIIRMLEFGSHLDLERMQASLPLDNISYRRESAI

SEQ ID NO: 58673 - protein, 419 aa, Homo sapiens
MAGDSRNAMNQDMEIGVTPWDPKKIPKQARDYVPIATDRTRLLAEGKKPRQRYMEKSGKCNVHHGNVQETYRYLSDLFTTLVDLKWRFNLLVFTMVYTVTWLFFGFIWWLIAYIRGDLDHVGDQEWIPCVENLSGFVSAFLFSIETETTIGYGFRVITEKCPEGIILLLVQAILGSIVNAFMVGCMFVKISQPKKRAETLMFSNNAVISMRDEKLCLMFRVGDLRNSHIVEASIRAKLIKSRQTKEGEFIPLNQTDINVGFDTGDDRLFLVSPLIISHEINQKSPFWEMSQAQLHQEEFEVVVILEGMVEATGMTCQARSSYMDTEVLWGHRFTPVLTLEKGFYEVDYNTFHDTYETNTPSCCAKELAEMKREGRLLQYLPSPPLLGGCAEAGLDAEAEQNEEDEPKGLGGSREARGSV

SEQ ID NO: 58674 - protein, 419 aa, Homo sapiens; identical to SEQ ID NO: 58673

SEQ ID NO: 58675 - protein, 419 aa, Homo sapiens; identical to SEQ ID NO: 58673

SEQ ID NO: 58676 - protein, 423 aa, Homo sapiens
MAKLTESMTNVLEGDSMDQDVESPVAIHQPKLPKQARDDLPRHISRDRTKRKIQRYVRKDGKCNVHHGNVRETYRYLTDIFTTLVDLKWRFNLLIFVMVYTVTWLFFGMIWWLIAYIRGDMDHIEDPSWTPCVTNLNGFVSAFLFSIETETTIGYGYRVITDKCPEGIILLLIQSVLGSIVNAFMVGCMFVKISQPKKRAETLVFSTHAVISMRDGKLCLMFRVGDLRNSHIVEASIRAKLIKSKQTSEGEFIPLNQTDINVGYYTGDDRLFLVSPLIISHEINQQSPFWEISKAQLPKEELEIVVILEGMVEATGMTCQARSSYITSEILWGYRFTPVLTLEDGFYEVDYNSFHETYETSTPSLSAKELAELASRAELPLSWSVSSKLNQHAELETEEEEKNLEEQTERNGDVANLENESKV

SEQ ID NO: 58677 - protein, 423 aa, Homo sapiens; identical to SEQ ID NO: 58676

SEQ ID NO: 58678 - protein, 424 aa, Homo sapiens
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSGLESTVCVTNVRSFTSAFLFSIEVQVTIGFGGRMMTEECPLAITVLILQNIVGLIINAVMLGCIFMKTAQAHRRAETLIFSRHAVIAVRNGKLCFMFRVGDLRKSMIISASVRIQVVKKTTTPEGEVVPIHQLDIPVDNPIESNNIFLVAPLIICHVIDKRSPLYDISATDLANQDLEVIVILEGVVETTGITTQARTSYIAEEIQWGHRFVSIVTEEEGVYSVDYSKFGNTVKVAAPRCSARELDEKPSILIQTLQKSELSHQNSLRKRNSMRRNNSMRRNNSIRRNNSSLMVPKVQFMTPEGNQNTSES

SEQ ID NO: 58679 - protein, 114 aa, Homo sapiens
MLARKSIIPEEYVLARIAAENLRKPRIRDRLPKARFIAKSGACNLAHKNIREQGRFLQDIFTTLVDLKWRHTLVIFTMSFLCSWLLFAIMWWLVAFAHGDIYAYMEKSGMEKSG

SEQ ID NO: 58680 - protein, 424 aa, Homo sapiens; identical to SEQ ID NO: 58678

SEQ ID NO: 58681 - protein, 257 aa, Homo sapiens
MTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 58682 - protein, 173 aa, Homo sapiens
MQPFSIPVQITLQGSRRRQGRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKRDVTDCRVKEKQTLTVSDEHKQ

SEQ ID NO: 58683 - protein, 279 aa, Homo sapiens
MDFSPSSELGFHFVAFILLTRHRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 58684 - protein, 277 aa, Homo sapiens
MQPFSIPVQITLQGSRRRQGRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 58685 - protein, 275 aa, Homo sapiens
MFPLLYELTAVSPSPFPQRTAFPASGKKRETDYSDGDPLDVHKRLPSSAGEDRAVMLGFAMMGFSVLMFFLLGTTILKPFMLSIQREESTCTAIHTDIMDDWLDCAFTCGVHCHGQGKYPCLQVFVNLSHPGQKALLHYNEEAVQINPKCFYTPKCHQDRNDLLNSALDIKEFFDHKNGTPFSCFYSPASQSEDVILIKKYDQMAIFHCLFWPSLTLLGGALIVGMVRLTQHLSLLCEKYSTVVRDEVGGKVPYIEQHQFKLCIMRRSKGRAEKS

SEQ ID NO: 58686 - protein, 257 aa, Homo sapiens; identical to SEQ ID NO: 58681

SEQ ID NO: 58687 - protein, 1178 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 58688 - protein, 1210 aa, Homo sapiens
SNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 58689 - protein, 1239 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRRWEEHCSLWRLESKGNVRRLNYCRGQQTFSVKVKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 58690 - protein, 1182 aa, Homo sapiens
  MOD_RES (1)..(1): Any amino acid
XSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQAEKKWFTDEPDNAYPRNIQIKPMSTHMANQINQYKSTSSLIPPIREVEDEC

SEQ ID NO: 58691 - protein, 1167 aa, Homo sapiens
PKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 58692 - protein, 1167 aa, Homo sapiens
  MOD_RES (1)..(1): Any amino acid
XGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 58693 - protein, 1171 aa, Homo sapiens
MDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 58694 - protein, 1177 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 58695 - protein, 1205 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELAKPGKLPLVSVNQEKNSGTHILMITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNRKEMVYR

SEQ ID NO: 58696 - protein, 1225 aa, Homo sapiens
PKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQNATRMNRMGQEKKWFTDEPDNAYPRNIQIKPMSTHMANQINQYKSTSSLIPPIREVEDEC

SEQ ID NO: 58697 - protein, 1219 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLEDEQPSTLSPKKKQRNGGMRNSPNTSPKLMRHDPLLIPGNDQIDNMDSNVKKYDSTGMFHWCAPKEIEKVILVTGWMPYLGPRVLMTCLDIGVVCMPTDIQSTSPASIKKFKETRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 58698 - protein, 1240 aa, Homo sapiens
MANGGGGGGGSSGGGGGGGGSSLRMSSNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRGRLSILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 58699 - protein, 989 aa, Homo sapiens [sequence omitted]

SEQ ID NO: 58700 - protein, 180 aa, Homo sapiens
  MOD_RES (1)..(1): Any amino acid
XKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRPPQLCLPLAAQKRCFQSDKLDIFI

SEQ ID NO: 58701 - protein, 886 aa, Homo sapiens
  MOD_RES (1)..(1): Any amino acid
XNSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLKVAARSRYSKDPFEFKKETPNSRLVTEPVEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKYVQEERL

SEQ ID NO: 58702 - protein, 264 aa, Homo sapiens
  MOD_RES (1)..(1): Any amino acid
XVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRLAGSQDTHPDSFYHQAVNASSYLHGGGQMWPVSSSSSILLHYLRRQMPGPARLPLELSCQGSALSPNPDLYCMK

SEQ ID NO: 58703 - protein, 1209 aa, Homo sapiens
SNIHANHLSLDASSSSSSSSSSSSSSSSSSSSSSVHEPKMDALIIPVTMEVPCDSRGQRMWWAFLASSMVTFFGGLFIILLWRTLKYLWTVCCHCGGKTKEAQKINNGSSQADGTLKPVDEKEEAVAAEVGWMTSVKDWAGVMISAQTLTGRVLVVLVFALSIGALVIYFIDSSNPIESCQNFYKDFTLQIDMAFNVFFLLYFGLRFIAANDKLWFWLEVNSVVDFFTVPPVFVSVYLNRSWLGLRFLRALRLIQFSEILQFLNILKTSNSIKLVNLLSIFISTWLTAAGFIHLVENSGDPWENFQNNQALTYWECVYLLMVTMSTVGYGDVYAKTTLGRLFMVFFILGGLAMFASYVPEIIELIGNRKKYGGSYSAVSGRKHIVVCGHITLESVSNFLKDFLHKDRDDVNVEIVFLHNISPNLELEALFKRHFTQVEFYQGSVLNPHDLARVKIESADACLILANKYCADPDAEDASNIMRVISIKNYHPKIRIITQMLQYHNKAHLLNIPSWNWKEGDDAICLAELKLGFIAQSCLAQGLSTMLANLFSMRSFIKIEEDTWQKYYLEGVSNEMYTEYLSSAFVGLSFPTVCELCFVKLKLLMIAIEYKSANRESRILINPGNHLKIQEGTLGFFIASDAKEVKRAFFYCKACHDDITDPKRIKKCGCKRPKMSIYKRMRRACCFDCGRSERDCSCMSGRVRGNVDTLERAFPLSSVSVNDCSTSFRAFEDEQPSTLSPKKKQRNGGMRNSPNTSPKLMRHDPLLIPGNDQIDNMDSNVKKYDSTGMFHWCAPKEIEKVILTRSEAAMTVLSGHVVVCIFGDVSSALIGLRNLVMPLRASNFHYHELKHIVFVGSIEYLKREWETLHNFPKVSILPGTPLSRADLRAVNINLCDMCVILSANQNNIDDTSLQDKECILASLNIKSMQFDDSIGVLQANSQGFTPPGMDRSSPDNSPVHGMLRQPSITTGVNIPIITELVNDTNVQFLDQDDDDDPDTELYLTQPFACGTAFAVSVLDSLMSATYFNDNILTLIRTLVTGGATPELEALIAEENALRGGYSTPQTLANRDRCRVAQLALLDGPFADLGDGGCYGDLFCKALKTYNMLCFGIYRLRDAHLSTPSQCTKRYVITNPPYEFELVPTDLIFCLMQFDHNAGQSRASLSHSSHSSQSSSKKSSSVHSIPSTANRQNRPKSRESRDKQKKEMVYR

SEQ ID NO: 58704 - protein, 191 aa, Homo sapiens
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQCSYIPGSVDNYQTARADVEKVRAKFQEQQVFYCFSAPRGNETSVLFQRLYGPQALLFSLFWPTFLLTGGLLIIAMVKSNQYLSILAAQK

SEQ ID NO: 58705 - protein, 130 aa, Homo sapiens
MVKKLVMAQKRGETRALCLGVTMVVCAVITYYILVTTVLPLYQKSVWTQESKCHLIETNIRDQEELKGKKVPQYPCLWVNVSAAGRWAVLYHTEDTRDQNQQVLNWRDGDTSLYPCQVCEPVPNCPCPRG

SEQ ID NO: 58706 - protein, 210 aa, Homo sapiens
MAKLRVAYEYTEAEDKSIRLGLFLIISGVVSLFIFGFCWLSPALQDLQATEANCTVLSVQQIGEVFECTFTCGADCRGTSQYPCVQVYVNNSESNSRALLHSDEHQLLTNPKCSYIPPCKRENQKNLESVMNWQQYWKDEIGSQPFTCYFNQHQRPDDVLLHRTHDEIVLLHCFLWPLVTFVVGVLIVVLTICAKSLAVKAEAMKKRKFS

SEQ ID NO: 58707 - protein, 752 aa, Homo sapiens
MKPAEHATMFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 58708 - protein, 477 aa, Homo sapiens
MTGQSLWDVSEANVEDGEIRINVGGFKRRLRSHTLLRFPETRLGRLLLCHSREAILELCDDYDDVQREFYFDRNPELFPYVLHFYHTGKLHVMAELCVFSFSQEIEYWGINEFFIDSCCSYSYHGRKVEPEQEKWDEQSDQESTTSSFDEILAFYNDASKFDGQPLGNFRRQLWLALDNPGYSVLSRVFSILSILVVMGSIITMCLNSLPDFQIPDSQGNPGEDPRFEIVEHFGIAWFTFELVARFAVAPDFLKFFKNALNLIDLMSIVPFYITLVVNLVVESTPTLANLGRVAQVLRLMRIFRILKLARHSTGLRSLGATLKYSYKEVGLLLLYLSVGISIFSVVAYTIEKEENEGLATIPACWWWATVSMTTVGYGDVVPGTTAGKLTASACILAGILVVVLPITLIFNKFSHFYRRQKQLESAMRSCDFGDGMKEVPSVNLRDYYAHKVKSLMASLTNMSRSSPSELSLNDSLR

SEQ ID NO: 58709 - protein, 477 aa, Homo sapiens; identical to SEQ ID NO: 58708

SEQ ID NO: 58710 - protein, 491 aa, Homo sapiens
MVFGEFFHRPGQDEELVNLNVGGFKQSVDQSTLLRFPHTRLGKLLTCHSEEAILELCDDYSVADKEYYFDRNPSLFRYVLNFYYTGKLHVMEELCVFSFCQEIEYWGINELFIDSCCSNRYQERKEENHEKDWDQKSHDVSTDSSFEESSLFEKELEKFDTLRFGQLRKKIWIRMENPAYCLSAKLIAISSLSVVLASIVAMCVHSMSEFQNEDGEVDDPVLEGVEIACIAWFTGELAVRLAAAPCQKKFWKNPLNIIDFVSIIPFYATLAVDTKEEESEDIENMGKVVQILRLMRIFRILKLARHSVGLRSLGATLRHSYHEVGLLLLFLSVGISIFSVLIYSVEKDDHTSSLTSIPICWWWATISMTTVGYGDTHPVTLAGKLIASTCIICGILVVALPITIIFNKFSKYYQKQKDIDVDQCSEDAPEKCHELPYFNIRDIYAQRMHTFITSLSSVGIVVSDPDSTDASSIEDNEDICNTTSLENCTAK

SEQ ID NO: 58711 - protein, 491 aa, Homo sapiens; identical to SEQ ID NO: 58710

SEQ ID NO: 58712 - protein, 74 aa, Homo sapiens
MVFGEFFHRPGQDEELVNLNVGGFKQSVDQSTLLRFPHTRLGKLLTCHSEEAILELCDDYSVADKEYYFDRNPS

SEQ ID NO: 58713 - protein, 129 aa, Homo sapiens
MILSNTTAVTPFLTKLWQETVQQGGNMSGLARRSPRSSDGKLEALYVLMVLGFFGFFTLGIMLSYIRSKKLEHSNDPFNVYIESDAWQEKDKAYVQARVLESYRSCYVVENHLAIEQPNTHLPETKPSP

SEQ ID NO: 58714 - protein, 129 aa, Homo sapiens; identical to SEQ ID NO: 58713

SEQ ID NO: 58715 - protein, 129 aa, Homo sapiens; identical to SEQ ID NO: 58713

SEQ ID NO: 58716 - protein, 129 aa, Homo sapiens; identical to SEQ ID NO: 58713

SEQ ID NO: 58717 - protein, 129 aa, Homo sapiens; identical to SEQ ID NO: 58713

SEQ ID NO: 58718 - protein, 129 aa, Homo sapiens; identical to SEQ ID NO: 58713

SEQ ID NO: 58719 - protein, 123 aa, Homo sapiens
MSTLSNFTQTLEDVFRRIFITYMDNWRQNTTAEQEALQAKVDAENFYYVILYLMVMIGMFSFIIVAILVSTVKSKRREHSNDPYHQYIVEDWQEKYKSQILNLEESKATIHENIGAAGFKMSP

SEQ ID NO: 58720 - protein, 103 aa, Homo sapiens
METTNGTETWYESLHAVLKALNATLHSNLLCRPGPGLGPDNQTEERRASLPGRDDNSYMYILFVMFLFAVTVGSLILGYTRSRKVDKRSDPYHVYIKNRVSMI

SEQ ID NO: 58721 - protein, 103 aa, Homo sapiens; identical to SEQ ID NO: 58720

SEQ ID NO: 58722 - protein, 12 aa, Homo sapiens
METTNGTETWYE

SEQ ID NO: 58723 - protein, 50 aa, Homo sapiens
METTNGTETWYESLHAVLKALNATLHSNLLCRPGPGLGPDNQTEERRASL

SEQ ID NO: 58724 - protein, 53 aa, Homo sapiens
METTNGTETWYESLHAVLKALNATLHSNLLCRPGPGLGPDNQTEERRASLPGR

SEQ ID NO: 58725 - protein, 99 aa, Homo sapiens
METTNGTETWYESLHAVLKALNATLHSNLLCRPGPGLGPDNQTEERRASLPGRDDNSYMYILFVMFLFAVTVGSLILGYTRSRKVDKRSDPYHVYIKNR

SEQ ID NO: 58726 - protein, 170 aa, Homo sapiens
MLKMEPLNSTHPGTAASSSPLESRAAGGGSGNGNEYFYILVVMSFYGIFLIGIMLGYMKSKRREKKSSLLLLYKDEERLWGEAMKPLPVVSGLRSVQVPLMLNMLQESVAPALSCTLCSMEGDSVSSESSSPDVHLTIQEEGADDELEETSETPLNESSEGSSENIHQNS

SEQ ID NO: 58727 - protein, 676 aa, Homo sapiens [sequence omitted]

SEQ ID NO: 58728 - protein, 549 aa, Homo sapiens
MDFLIVLVCLIFSVLSTIEQYAALATGTLFWMEIVLVVFFGTEYVVRLWSAGCRSKYVGLWGRLRFARKPISIIDLIVVVASMVVLCVGSKGQVFATSAIRGIRFLQILRMLHVDRQGGTWRLLGSVVFIHRQELITTLYIGFLGLIFSSYFVYLAEKDAVNESGRVEFGSYADALWWGVVTVTTIGYGDKVPQTWVGKTIASCFSVFAISFFALPAGILGSGFALKVQQKQRQKHFNRQIPAAASLIQTAWRCYAAENPDSSTWKIYIRKAPRSHTLLSPSPKPKKSVVVKKKKFKLDKDNGVTPGEKMLTVPHITCDPPEERRLDHFSVDGYDSSVRKSPTLLEVSMPHFMRTNSFAEDLDLEGETLLTPITHISQLREHHRATIKVIRRMQYFVAKKKFQQARKPYDVRDVIEQYSQGHLNLMVRIKELQRRLDQSIGKPSLFISVSEKSKDRGSNTIGARLNRVEDKVTQLDQRLALITDMLHQLLSLHGGSTPGSGGPPREGGAHITQPCGSGGSVDPELFLPSNTLPTYEQLTVPRRGPDEGS

SEQ ID NO: 58729 - protein, 393 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRYRRRAPATKQLFHFLFSICS

SEQ ID NO: 58730 - protein, 868 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRIDMIVGPPPPSTPRHKKYPTKGPTAPPRESPQYSPRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 58731 - protein, 880 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQTGIDMIVGPPPPSTPRHKKYPTKGPTAPPRESPQYSPRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 58732 - protein, 854 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 58733 - protein, 872 aa, Homo sapiens [sequence omitted]

SEQ ID NO: 58734 - protein, 872 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSKGSPCRGPLCGCCPGRSSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSQVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 58735 - protein, 844 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 58736 - protein, 436 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPRSVPPAATLVSAVCTAVWSLSHTCAQPVMEM

SEQ ID NO: 58737 - protein, 615 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRQEPRLPVQQGTRTGWASGTKPTVAHGGSAGGVWAGPPPHPRRPLSASVVSSQSLF

SEQ ID NO: 58738 - protein, 880 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYRLIPPLNQLELLRNLKSKSGLAFRKDPPPEPSPSQKVSLKDRVFSSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRIDMIVGPPPPSTPRHKKYPTKGPTAPPRESPQYSPRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 58739 - protein, 842 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSEEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 58740 - protein, 841 aa, Homo sapiens
MVQKSRNGGVYPGPSGEKKLKVGFVGLDPGAPDSTRDGALLIAGSEAPKRGSILSKPRAGGAGAGKPPKRNAFYRKLQNFLYNVLERPRGWAFIYHAYVFLLVFSCLVLSVFSTIKEYEKSSEGALYILEIVTIVVFGVEYFVRIWAAGCCCRYRGWRGRLKFARKPFCVIDIMVLIASIAVLAAGSQGNVFATSALRSLRFLQILRMIRMDRRGGTWKLLGSVVYAHSKELVTAWYIGFLCLILASFLVYLAEKGENDHFDTYADALWWGLITLTTIGYGDKYPQTWNGRLLAATFTLIGVSFFALPAGILGSGFALKVQEQHRQKHFEKRRNPAAGLIQSAWRFYATNLSRTDLHSTWQYYERTVTVPMYSSQTQTYGASRLIPPLNQLELLRNLKSKSGLAFRKDPPPEPSPSPRGVAAKGKGSPQAQTVRRSPSADQSLEDSPSKVPKSWSFGDRSRARQAFRIKGAASRQNSEASLPGEDIVDDKSCPCEFVTEDLTPGLKVSIRAVCVMRFLVSKRKFKESLRPYDVMDVIEQYSAGHLDMLSRIKSLQSRVDQIVGRGPAITDKDRTKGPAEAELPEDPSMMGRLGKVEKQVLSMEKKLDFLVNIYMQRMGIPPTETEAYFGAKEPEPAPPYHSPEDSREHVDRHGCIVKIVRSSSSTGQKNFSAPPAAPPVQCPPSTSWQPQSHPRQGHGTSPVGDHGSLVRIPPPPAHERSLSAYGGGNRASMEFLRQEDTPGCRPPEGNLRDSDTSISIPSVDHEELERSFSGFSISQSKENLDALNSCYAAVAPCAKVRPYIAEGESDTDSDLCTPCGPPPRSATGEGPFGDVGWAGPRK

SEQ ID NO: 58741 - protein, 872 aa, Homo sapiens
MGLKARRAAGAAGGGGDGGGGGGGAANPAGGDAAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGSAFTFPSQQSPRNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 58742 - protein, 751 aa, Homo sapiens [sequence omitted]

SEQ ID NO: 58743 - protein, 849 aa, Homo sapiens
RAAAEKAKRPAGARQMGLKARRAAAGDEERKVGLAPGDVEQVTLALGAGADKDGTLLLEGGGRDEGQRRTPQGIGLLAKTPLSRPVKRNNAKYRRIQTLIYDALERPRGWALLYHALVFLIVLGCLILAVLTTFKEYETVSGDWLLLLETFAIFIFGAEFALRIWAAGCCCRYKGWRGRLKFARKPLCMLDIFVLIASVPVVAVGNQGNVLATSLRSLRFLQILRMLRMDRRGGTWKLLGSAICAHSKELITAWYIGFLTLILSSFLVYLVEKDVPEVDAQGEEMKEEFETYADALWWGLITLATIGYGDKTPKTWEGRLIAATFSLIGVSFFALPAGILGSGLALKVQEQHRQKHFEKRRKPAAELIQAAWRYYATNPNRIDLVATWRFYESVVSFPFFRKEQLEAASSQKLGLLDRVRLSNPRGSNTKGKLFTPLNVDAIEESPSKEPKPVGLNNKERFRTAFRMKAYAFWQSSEDAGTGDPMAEDRGYGNDFPIEDMIPTLKAAIRAVRILQFRLYKKKFKETLRPYDVKDVIEQYSAGHLDMLSRIKYLQTRIDMIFTPGPPSTPKHKKSQKGNEPYVARPSTSEIEDQSMMGKFVKVERQVQDMGKKLDFLVDMHMQHMERLQVQVTEYYPTKGTSSPAEAEKKEDNRYSDLKTIICNYSETGPPEPPYSFHQVTIDKVSPYGFFAHDPVNLPRGGPSSGKVQATPPSSATTYVERPTVLPILTLLDSRVSCHSQADLQGPYSDRISPRQRRSITRDSDTPLSLMSVNHEELERSPSGFSISQDRDDYVFGPNGGSSWMREKRYLAEGETDTDTDPFTPSGSMPLSSTGDGISDSVWTPSNKPI

SEQ ID NO: 58744 - protein, 695 aa, Homo sapiens [sequence omitted]

SEQ ID NO: 58745 - protein, 951 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSKFCSNKQKLFRMYTSRKQSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 58746 - protein, 932 aa, Homo sapiens [sequence omitted]

SEQ ID NO: 58747 - protein, 933 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKQNQQGESQSCQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 58748 - protein, 427 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSRFVISLLLHVCL

SEQ ID NO: 58749 - protein, 932 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 58750 - protein, 942 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTNKFCSNKQKLFRMYTSRKQSQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 58751 - protein, 923 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTNQKLSFKERVRMASPRGQSIKSRQASVGDRRSPSTDITAEGSPTKVQKSWSFNDRTRFRPSLRLKSSQPKPVIDADTALGTDDVYDEKGCQCDVSVEDLTPPLKTVIRAIRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 58752 - protein, 822 aa, Homo sapiens
MPRHHAGGEEGGAAGLWVKSGAAAAAAGGGRLGSGMKDVESGRGRVLLNSAAARGDGLLLLGTRAATLGGGGGGLRESRRGKQGARMSLLGKPLSYTSSQSCRRNVKYRRVQNYLYNVLERPRGWAFIYHAFVFLLVFGCLILSVFSTIPEHTKLASSCLLILEFVMIVVFGLEFIIRIWSAGCCCRYRGWQGRLRFARKPFCVIDTIVLIASIAVVSAKTQGNIFATSALRSLRFLQILRMVRMDRRGGTWKLLGSVVYAHSKELITAWYIGFLVLIFSSFLVYLVEKDANKEFSTYADALWWGTITLTTIGYGDKTPLTWLGRLLSAGFALLGISFFALPAGILGSGFALKVQEQHRQKHFEKRRNPAANLIQCVWRSYAADEKSVSIATWKPHLKALHTCSPTKKEQGEASSRIMKFHVAKRKFKETLRPYDVKDVIEQYSAGHLDMLCRIKSLQTRVDQILGKGQITSDKKSREKITAEHETTDDLSMLGRVVKVEKQVQSIESKLDCLLDIYQQVLRKGSASALALASFQIPPFECEQTSDYQSPVDSKDLSGSAQNSGCLSRSTSANISRGLQFILTPNEFSAQTFYALSPTMHSQATQVPISQSDGSAVAATNTIANQINTAPKPAAPTTLQIPPPLPAIKHLPRPETLHPNPAGLQESISDVTTCLVASKENVQVAQSNLTKDRSMRKSFDMGGETLLSVCPMVPKDLGKSLSVQNLIRSTEELNIQLSGSESSGSRGSQDFYPKWRESKLFITDEEVGPEETETDTFDAAPQPAREAAFASDSLRTGRSRSSQSICKAGESTDALSLPHVKLK

SEQ ID NO: 58753 - protein, 951 aa, Homo sapiens [sequence omitted]

SEQ ID NO: 58754 - protein, 858 aa, Homo sapiens [sequence omitted]

SEQ ID NO: 58755 - protein, 813 aa, Homo sapiens
RDGGEKTAVTRLGKLRDCNTHDSLLEVCDDYSLDDNEYFFDRHPGAFTSILNFYRTGRLHMMEEMCALSFSQELDYWGIDEIYLESCCQARYHQKKEQMNEELKREAETLREREGEEFDNTCCAEKRKKLWDLLEKPNSSVAAKILAIISIMFIVLSTIALSLNTLPELQSLDEFGQSTDNPQLAHVEAVCIAWFTMEYLLRFLSSPKKWKFFKGPLNAIDLLAILPYYVTIFLTESNKSVLQFQNVRRVVQIFRIMRILRILKLARHSTGLQSLGFTLRRSYNELGLLILFLAMGIMIFSSLVFFAEKDEDDTKFKSIPASFWWATITMTTVGYGDIYPKTLLGKIVGGLCCIAGVLVIALPIPIIVNNFSEFYKEQKRQEKAIKRREALERAKRNGSIVSMNMKDAFARSIEMMDIVVEKNGENMGKKDKVQDNHLSPNKWKWTKRTLSETSSSKSFETKEQGSPEKARSSSSPQHLNVQQLEDMYNKMAKTQSQPILNTKESAAQSKPKEELEMESIPSPVAPLPTRTEGVIDMRSMSSIDSFISCATDFPEATRFSHSPLTSLPSKTGGSTAPEVGWRGALGASGGRFVEANPSPDASQHSSFFIESPKSSMKTNNPLKLRALKVNFMEGDPSPLLPVLGMYHDPLRNRGSAAAAVAGLECATLLDKAVLSPESSIYTTASAKTPPRSPEKHTAIAFNFEAGVHQYIDADTDDEGQLLYSVDSSPPKSLPGSTSPKFSTGTRSEKNHFESSPLPTSPKFLRQNCIYSTEALTGKGPSGQEKCKLENHISPDVRVLPGGGAHGSTRDQSI

SEQ ID NO: 58756 - protein, 911 aa, Homo sapiens
MAEKAPPGLNRKTSRSTLSLPPEPVDIIRSKTCSRRVKINVGGLNHEVLWRTLDRLPRTRLGKLRDCNTHESLLEVCDDYNLNENEYFFDRHPGAFTSILNFYRTGKLHMMEEMCALSFGQELDYWGIDEIYLESCCQARYHQKKEQMNEELRREAETMREREGEEFDNTCCPDKRKKLWDLLEKPNSSVAAKILAIVSILFIVLSTIALSLNTLPELQETDEFGQLNDNRQLAHVEAVCIAWFTMEYLLRFLSSPNKWKFFKGPLNVIDLLAILPYYVTIFLTESNKSVLQFQNVRRVVQIFRIMRILRILKLARHSTGLQSLGFTLRRSYNELGLLILFLAMGIMIFSSLVFFAEKDEDATKFTSIPASFWWATITMTTVGYGDIYPKTLLGKIVGGLCCIAGVLVIALPIPIIVNNFSEFYKEQKRQEKAIKRREALERAKRNGSIVSMNLKDAFARSMELIDVAVEKAGESANTKDSADDNHLSPSRWKWARKALSETSSNKSFENKYQEVSQKDSHEQLNNTSSSSPQHLSAQKLEMLYNEITKTQPHSHPNPDCQEKPERPSAYEEEIEMEEVVCPQEQLAVAQTEVIVDMKSTSSIDSFTSCATDFTETERSPLPPPSASHLQMKFPTDLPGTEEHQRARGPPFLTLSREKGPAARDGTLEYAPVDITVNLDASGSQCGLHSPLQSDNATDSPKSSLKGSNPLKSRSLKVNFKENRGSAPQTPPSTARPLPVTTADFSLTTPQHISTILLEETPSQGDRPLLGTEVSAPCQGPSKGLSPRFPKQKLFPFSSRERRSFTEIDTGDDEDFLELPGAREEKQVDSSPNCFADKPSDGRDPLREEGSVGSSSPQDTGHNCRQDIYHAVSEVKKDSSQEGCKMENHLFAPEIHSNPGDTGYCPTRETSM

SEQ ID NO: 58757 - protein, 401 aa, Homo sapiens
MQVSIACTEHNLKSRNGEDRLLSKQSSTAPNVVNAARAKFRTVAIIARSLGTFTPQHHISLKESTAKQTGMKYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 58758 - protein, 390 aa, Homo sapiens
MLAARTGAAGSQISEENTKLRRQSGFSVAGKDKSPKKASENAKDSSLSPSGESQLRARQLALLREVEMNWYLKLCDLSSEHTTVCTTGMPHRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 58759 - protein, 408 aa, Homo sapiens
MHLYKPACADIPSPKLGLPKSSESALKCRWHLAVTKTQPQAACKPVRPSGAAEQKYVEKFLRVHGISLQETTRAETGMAYRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 58760 - protein, 419 aa, Homo sapiens
MLAARTGAAGSQISEENTKLRRQSGFSVAGKDKSPKKASENAKDSSLSPSGESQLRARQLALLREVEMNWYLKLCDLSSEHTTVCTTGMPHRNLGKSGLRVSCLGLGTWVTFGGQISDEVAERLMTIAYESGVNLFDTAEVYAAGKAEVILGSIIKKKGWRRSSLVITTKLYWGGKAETERGLSRKHIIEGLKGSLQRLQLEYVDVVFANRPDSNTPMEEIVRAMTHVINQGMAMYWGTSRWSAMEIMEAYSVARQFNMIPPVCEQAEYHLFQREKVEVQLPELYHKIGVGAMTWSPLACGIISGKYGNGVPESSRASLKCYQWLKERIVSEEGRKQQNKLKDLSPIAERLGCTLPQLAVAWCLRNEGVSSVLLGSSTPEQLIENLGAIQVLPKMTSHVVNEIDNILRNKPYSKKDYRS

SEQ ID NO: 58761 - protein, 367 aa, Homo sapiens
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 58762 - protein, 367 aa, Homo sapiens; identical to SEQ ID NO: 58761

SEQ ID NO: 58763 - protein, 353 aa, Homo sapiens
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 58764 - protein, 415 aa, Homo sapiens
MLSMTYSESLRSVSSRCHSEWALHPVRQTDTLELQRLREVRAAAQARNMESFLRMHGLSLDGCTAQRTGMKYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEGDPFSSSKSRTFIIEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 58765 - protein, 173 aa, Homo sapiens
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWSQQGERAGQARVTPPCSLGRRARDASKSAGAGCHLQAQACVPSSTQALQTTRGRAPLKPPPPLAS

SEQ ID NO: 58766 - protein, 353 aa, Homo sapiens; identical to SEQ ID NO: 58763

SEQ ID NO: 58767 - protein, 367 aa, Homo sapiens; identical to SEQ ID NO: 58761

SEQ ID NO: 58768 - protein, 173 aa, Homo sapiens
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRQRGERAGQARVTPPCSLGRRARDASKSAGAGCHLQAQACVPSSTQALQTTRGRAPLKPPPPLAS

SEQ ID NO: 58769 - protein, 253 aa, Homo sapiens
MYPESTTGSPARLSLRQTGSPGMIYSTRYGSPKRQLQFYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSG

SEQ ID NO: 58770 - protein, 254 aa, Homo sapiens
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLK

SEQ ID NO: 58771 - protein, 95 aa, Homo sapiens
MYPESTTGSPARLSLRQTGSPGMIYRNLGKSGLRVSCLGLGTWVTFGGQITDEMAEQLMTLAYDNGINLFDTAEVYAAGKAEVVLGNIIKKKGWR

SEQ ID NO: 58772 - protein, 52 aa, Homo sapiens
MYPESTTGSPARLSLRQTGSPGMIYSTRYGSPKRQLQFYRNLGKSGLRVSCL

SEQ ID NO: 58773 - protein, 300 aa, Homo sapiens
MAEQLMTLAYDNGINLFDTAEVYAAGKAEVVLGNIIKKKGWRRSSLVITTKIFWGGKAETERGLSRKHIIEGLKASLERLQLEYVDVVFANRPDPNTPMEETVRAMTHVINQGMAMYWGTSRWSSMEIMEAYSVARQFNLTPPICEQAEYHMFQREKVEVQLPELFHKIGVGAMTWSPLACGIVSGKYDSGIPPYSRASLKGYQWLKDKILSEEGRRQQAKLKELQAIAERLGCTLPQLAIAWCLRNEGVSSVLLGASNADQLMENIGAIQVLPKLSSSIIHEIDSILGNKPYSKKDYRS

SEQ ID NO: 58774 - protein, 404 aa, Homo sapiens
MQVSIACTEQNLRSRSSEDRLCGPRPGPGGGNGGPAGGGHGNPPGGGGSGPKARAALVPRPPAPAGALRESTGRGTGMKYRNLGKSGLRVSCLGLGTWVTFGSQISDETAEDVLTVAYEHGVNLFDTAEVYAAGKAERTLGNILKSKGWRRSSYVITTKIFWGGQAETERGLSRKHIIEGLRGSLERLQLGYVDIVFANRSDPNCPMEEIVRAMTYVINQGLALYWGTSRWGAAEIMEAYSMARQFNLIPPVCEQAEHHLFQREKVEMQLPELYHKIGVGSVTWYPLACGLITSKYDGRVPDTCRASIKGYQWLKDKVQSEDGKKQQAKVMDLLPVAHQLGCTVAQLAIAWCLRSEGVSSVLLGVSSAEQLIEHLGALQVLSQLTPQTVMEIDGLLGNKPHSKK

SEQ ID NO: 58775 - protein, 495 aa, Homo sapiens
MTVMSGENVDEASAAPGHPQDGSYPRQADHDDHECCERVVINISGLRFETQLKTLAQFPNTLLGNPKKRMRYFDPLRNEYFFDRNRPSFDAILYYYQSGGRLRRPVNVPLDMFSEEIKFYELGEEAMEKFREDEGFIKEEERPLPEKEYQRQVWLLFEYPESSGPARVIAIVSVMVILISIVIFCLETLPELKDDKDFTGTVHRIDNTTVIYNSNIFTDPFFIVETLCIIWFSFELVVRFFACPSKTDFFKNIMNFIDIVAIIPYFITLGTEIAEQEGNQKGEQATSLAILRVIRLVRVFRIFKLSRHSKGLQILGQTLKASMRELGLLIFFLFIGVILFSSAVYFAEAEEAESHFSSIPDAFWWAVVSMTTVGYGDMYPVTIGGKIVGSLCAIAGVLTIALPVPVIVSNFNYFYHRETEGEEQAQLLHVSSPNLASDSDLSRRSSSTMSKSEYMEIEEDMNNSIAHYRQVNIRTANCTTANQNCVNKSKLLTDV

SEQ ID NO: 58776 - protein, 495 aa, Homo sapiens; identical to SEQ ID NO: 58775

SEQ ID NO: 58777 - protein, 511 aa, Homo sapiens
MDVCGWKEMEVALVNFDNSDEIQEEPGYATDFDSTSPKGRPGGSSFSNGKILISESTNHETAFSKLPGDYADPPGPEPVVLNEGNQRVIINIAGLRFETQLRTLSQFPETLLGDREKRMQFFDSMRNEYFFDRNRPSFDGILYYYQSGGKIRRPANVPIDIFADEISFYELGSEAMDQFREDEGFIKDPETLLPTNDIHRQFWLLFEYPESSSAARAVAVVSVLVVVISITIFCLETLPEFREDRELKVVRDPNLNMSKTVLSQTMFTDPFFMVESTCIVWFTFELVLRFVVCPSKTDFFRNIMNIIDIISIIPYFATLITELVQETEPSAQQNMSLAILRIIRLVRVFRIFKLSRHSKGLQILGQTLKASMRELGLLIFFLFIGVILFSSAVYFAEVDEPESHFSSIPDGFWWAVVTMTTVGYGDMCPTTPGGKIVGTLCAIAGVLTIALPVPVIVSNFNYFYHRETENEEKQNIPGEIERILNSVGSRMGSTDSLNKTNGGCSTEKSRK

SEQ ID NO: 58778 - protein, 575 aa, Homo sapiens
MDERLSLLRSPPPPSARHRAHPPQRPASSGGAHTLVNHGYAEPAAGRELPPDMTVVPGDHLLEPEVADGGGAPPQGGCGGGGCDRYEPLPPSLPAAGEQDCCGERVVINISGLRFETQLKTLCQFPETLLGDPKRRMRYFDPLRNEYFFDRNRPSFDAILYYYQSGGRIRRPVNVPIDIFSEEIRFYQLGEEAMEKFREDEGFLREEERPLPRRDFQRQVWLLFEYPESSGPARGIAIVSVLVILISIVIFCLETLPEFRDEKDYPASTSQDSFEAAGNSTSGSRAGASSFSDPFFVVETLCIIWFSFELLVRFFACPSKATFSRNIMNLIDIVAIIPYFITLGTELAERQGNGQQAMSLAILRVIRLVRVFRIFKLSRHSKGLQILGQTLKASMRELGLLIFFLFIGVILFSSAVYFAEADDPTSGFSSIPDAFWWAVVTMTTVGYGDMHPVTIGGKIVGSLCAIAGVLTIALPVPVIVSNFNYFYHRETEGEEQSQYMHVGSCQHLSSSAEELRKARSNSTLSKSEYMVIEEGGMNHSAFPQTPFKTGNSTATCTTNNNPNSCVNIKKIFTDV

SEQ ID NO: 58779 - protein, 653 aa, Homo sapiens
MEVAMVSAESSGCNSHMPYGYAAQARARERERLAHSRAAAAAAVAAATAAVEGSGGSGGGSHHHHQSRGACTSHDPQSSRGSRRRRRQRSEKKKAHYRQSSFPHCSDLMPSGSEEKILRELSEEEEDEEEEEEEEEEGRFYYSEDDHGDECSYTDLLPQDEGGGGYSSVRYSDCCERVVINVSGLRFETQMKTLAQFPETLLGDPEKRTQYFDPLRNEYFFDRNRPSFDAILYYYQSGGRLKRPVNVPFDIFTEEVKFYQLGEEALLKFREDEGFVREEEDRALPENEFKKQIWLLFEYPESSSPARGIAIVSVLVILISIVIFCLETLPEFRDDRDLVMALSAGGHGGLLNDTSAPHLENSGHTIFNDPFFIVETVCIVWFSFEFVVRCFACPSQALFFKNIMNIIDIVSILPYFITLGTDLAQQQGGGNGQQQQAMSFAILRIIRLVRVFRIFKLSRHSKGLQILGHTLRASMRELGLLIFFLFIGVILFSSAVYFAEADEPTTHFQSIPDAFWWAVVTMTTVGYGDMKPITVGGKIVGSLCAIAGVLTIALPVPVIVSNFNYFYHRETENEEQTQLTQNAVSCPYLPSNLLKKFRSSTSSSLGDKSEYLEMEEGVKESLCAKEEKCQGKGDDSETDKNNCSNAKAVETDV

SEQ ID NO: 58780 - protein, 613 aa, Homo sapiens
MEIALVPLENGGAMTVRGGDEARAGCGQATGGELQCPPTAGLSDGPKEPAPKGRGAQRDADSGVRPLPPLPDPGVRPLPPLPEELPRPRRPPPEDEEEEGDPGLGTVEDQALGTASLHHQRVHINISGLRFETQLGTLAQFPNTLLGDPAKRLRYFDPLRNEYFFDRNRPSFDGILYYYQSGGRLRRPVNVSLDVFADEIRFYQLGDEAMERFREDEGFIKEEEKPLPRNEFQRQVWLIFEYPESSGSARAIAIVSVLVILISIITFCLETLPEFRDERELLRHPPAPHQPPAPAPGANGSGVMAPPSGPTVAPLLPRTLADPFFIVETTCVIWFTFELLVRFFACPSKAGFSRNIMNIIDVVAIFPYFITLGTELAEQQPGGGGGGQNGQQAMSLAILRVIRLVRVFRIFKLSRHSKGLQILGKTLQASMRELGLLIFFLFIGVILFSSAVYFAEADNQGTHFSSIPDAFWWAVVTMTTVGYGDMRPITVGGKIVGSLCAIAGVLTIALPVPVIVSNFNYFYHRETDHEEPAVLKEEQGTQSQGPGLDRGVQRKVSGSRGSFCKAGGTLENADSARRGSCPLEKCNVKAKSNVDLRRSLYALCLDTSRETDL

SEQ ID NO: 58781 - protein, 456 aa, Homo sapiens
MEPRCPPPCGCCERLVLNVAGLRFETRARTLGRFPDTLLGDPARRGRFYDDARREYFFDRHRPSFDAVLYYYQSGGRLRRPAHVPLDVFLEEVAFYGLGAAALARLREDEGCPVPPERPLPRRAFARQLWLLFEFPESSQAARVLAVVSVLVILVSIVVFCLETLPDFRDDRDGTGLAAAAAAGPFPAPLNGSSQMPGNPPRLPFNDPFFVVETLCICWFSFELLVRLLVCPSKAIFFKNVMNLIDFVAILPYFVALGTELARQRGVGQQAMSLAILRVIRLVRVFRIFKLSRHSKGLQILGQTLRASMRELGLLIFFLFIGVVLFSSAVYFAEVDRVDSHFTSIPESFWWAVVTMTTVGYGDMAPVTVGGKIVGSLCAIAGVLTISLPVPVIVSNFSYFYHRETEGEEAGMFSHVDMQPCGPLEGKANGGLVDGEVPELPPPLWAPPGKHLVTEV

SEQ ID NO: 58782 - protein, 630 aa, Homo sapiens
MAAGVAAWLPFARAAAIGWMPVASGPMPAPPRQERKRTQDALIVLNVSGTRFQTWQDTLERYPDTLLGSSERDFFYHPETQQYFFDRDPDIFRHILNFYRTGKLHYPRHECISAYDEELAFFGLIPEIIGDCCYEEYKDRRRENAERLQDDADTDTAGESALPTMTARQRVWRAFENPHTSTMALVFYYVTGFFIAVSVIANVVETVPCGSSPGHIKELPCGERYAVAFFCLDTACVMIFTVEYLLRLAAAPSRYRFVRSVMSIIDVVAILPYYIGLVMTDNEDVSGAFVTLRVFRVFRIFKFSRHSQGLRILGYTLKSCASELGFLLFSLTMAIIIFATVMFYAEKGSSASKFTSIPAAFWYTIVTMTTLGYGDMVPKTIAGKIFGSICSLSGVLVIALPVPVIVSNFSRIYHQNQRADKRRAQKKARLARIRAAKSGSANAYMQSKRNGLLSNQLQSSEDEQAFVSKSGSSFETQHHHLLHCLEKTTNHEFVDEQVFEESCMEVATVNRPSSHSPSLSSQQGVTSTCCSRRHKKTFRIPNANVSGSHQGSIQELSTIQIRCVERTPLSNSRSSLNAKMEECVKLNCEQPYVTTAIISIPTPPVTTPEGDDRPESPEYSGGNIVRVSAL

SEQ ID NO: 58783 - protein, 636 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 58784 - protein, 655 aa, Homo sapiens
MAAGVAAWLPFARAAAIGWMPVANCPMPLAPADKNKRQDELIVLNVSGRRFQTWRTTLERYPDTLLGSTEKEFFFNEDTKEYFFDRDPEVFRCVLNFYRTGKLHYPRYECISAYDDELAFYGILPEIIGDCCYEEYKDRKRENAERLMDDNDSENNQESMPSLSFRQTMWRAFENPHTSTLALVFYYVTGFFIAVSVITNVVETVPCGTVPGSKELPCGERYSVAFFCLDTACVMIFTVEYLLRLFAAPSRYRFIRSVMSIIDVVAIMPYYIGLVMTNNEDVSGAFVTLRVFRVFRIFKFSRHSQGLRILGYTLKSCASELGFLLFSLTMAIIIFATVMFYAEKGSSASKFTSIPASFWYTIVTMTTLGYGDMVPKTIAGKIFGSICSLSGVLVIALPVPVIVSNFSRIYHQNQRADKRRAQKKARLARIRVAKTGSSNAYLHSKRNGLLNEALELTGTPEEEHMGKTTSLIESQHHHLLHCLEKTTGLSYLVDDPLLSVRTSTIKNHEFIDEQMFEQNCMESSMQNYPSTRSPSLSSHPGLTTTCCSRRSKKTTHLPNSNLPATRLRSMQELSTIHIQGSEQPSLTTSRSSLNLKADDGLRPNCKTSQITTAIISIPTPPALTPEGESRPPPASPGPNTNIPSIASNVVKVSAL

SEQ ID NO: 58785 - protein, 636 aa, Homo sapiens; identical to SEQ ID NO: 58783

SEQ ID NO: 58786 - protein, 585 aa, Homo sapiens
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRADSKLNGEVAKAALANEDCPHIDQALTPDEGLPFTRSGTRERYGPCFLLSTGEYACPPGGGMRKDLCKESPVIAKYMPTEAVRVT

SEQ ID NO: 58787 - protein, 511 aa, Homo sapiens
MGQGDESERIVINVGGTRHQTYRSTLRTLPGTRLAWLAEPDAHSHFDYDPRADEFFFDRHPGVFAHILNYYRTGKLHCPADVCGPLYEEELAFWGIDETDVEPCCWMTYRQHRDAEEALDSFGGAPLDNSADDADADGPGDSGDGEDELEMTKRLALSDSPDGRPGGFWRRWQPRIWALFEDPYSSRYARYVAFASLFFILVSITTFCLETHERFNPIVNKTEIENVRNGTQVRYYREAETEAFLTYIEGVCVVWFTFEFLMRVIFCPNKVEFIKNSLNIIDFVAILPFYLEVGLSGLSSKAAKDVLGFLRVVRFVRILRIFKLTRHFVGLRVLGHTLRASTNEFLLLIIFLALGVLIFATMIYYAERIGAQPNDPSASEHTHFKNIPIGFWWAVVTMTTLGYGDMYPQTWSGMLVGALCALAGVLTIAMPVPVIVNNFGMYYSLAMAKQKLPKKKKKHIPRPPQLGSPNYCKSVVNSPHHSTQSDTCPLAQEEILEINRAGRKPLRGMSI

SEQ ID NO: 58788 - protein, 613 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKDNCKEVVITGYTQAEARSLT

SEQ ID NO: 58789 - protein, 629 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKVLYRIYHGLLTAEKGTVEFSHTKDYTGNRLLLLNVP

SEQ ID NO: 58790 - protein, 558 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSDNCKEVVITGYTQAEARSLT

SEQ ID NO: 58791 - protein, 613 aa, Homo sapiens; identical to SEQ ID NO: 58788

SEQ ID NO: 58792 - protein, 638 aa, Homo sapiens
MGKIENNERVILNVGGTRHETYRSTLKTLPGTRLALLASSEPPGDCLTTAGDKLQPSPPPLSPPPRAPPLSPGPGGCFEGGAGNCSSRGGRASDHPGGGREFFFDRHPGVFAYVLNYYRTGKLHCPADVCGPLFEEELAFWGIDETDVEPCCWMTYRQHRDAEEALDIFETPDLIGGDPGDDEDLAAKRLGIEDAAGLGGPDGKSGRWRRLQPRMWALFEDPYSSRAARFIAFASLFFILVSITTFCLETHEAFNIVKNKTEPVINGTSVVLQYEIETDPALTYVEGVCVVWFTFEFLVRIVFSPNKLEFIKNLLNIIDFVAILPFYLEVGLSGLSSKAAKDVLGFLRVVRFVRILRIFKLTRHFVGLRVLGHTLRASTNEFLLLIIFLALGVLIFATMIYYAERVGAQPNDPSASEHTQFKNIPIGFWWAVVTMTTLGYGDMYPQTWSGMLVGALCALAGVLTIAMPVPVIVNNFGMYYSLAMAKQKLPRKRKKHIPPAPQASSPTFCKTELNMACNSTQSDTCLGKDNRLLEHNRSVLSGDDSTGSEPPLSPPERLPIRRSSTRDKNRRGETCFLLTTGDYTCASDGGIRKGYEKSRSLNNIAGLAGNALRLSPVTSPYNSPCPLRRSRSPIPSIL

SEQ ID NO: 58793 - protein, 629 aa, Homo sapiens; identical to SEQ ID NO: 58789

SEQ ID NO: 58794 - protein, 728 aa, Homo sapiens
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKALVTA

SEQ ID NO: 58795 - protein, 155 aa, Homo sapiens
MGIRQQLRLPTRTAQPLTSLPCPRKTRAPSRLEAVAAIAGTEPASSSPTMPLPLMAPSEKLLSPPETSRDFRSPPPLPPRLREIPQPQQHRGPERGVPAPRAPCHPPWLSPGRPPRSPDPALHPLALPSPLWGDSGVTGKKVKGAGGGGWGKGFF

SEQ ID NO: 58796 - protein, 542 aa, Homo sapiens
MTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKALVTA

SEQ ID NO: 58797 - protein, 757 aa, Homo sapiens
MLSSVCVSSFRGRQGASKQQPAPPPQPPESPPPPPLPPQQQQPAQPGPAASPAGPPAPRGPGDRRAEPCPGLPAAAMGRHGGGGGDSGKIVINVGGVRHETYRSTLRTLPGTRLAGLTEPEAAARFDYDPGADEFFFDRHPGVFAYVLNYYRTGKLHCPADVCGPLFEEELGFWGIDETDVEACCWMTYRQHRDAEEALDSFEAPDPAGAANAANAAGAHDGGLDDEAGAGGGGLDGAGGELKRLCFQDAGGGAGGPPGGAGGAGGTWWRRWQPRVWALFEDPYSSRAARYVAFASLFFILISITTFCLETHEGFIHISNKTVTQASPIPGAPPENITNVEVETEPFLTYVEGVCVVWFTFEFLMRITFCPDKVEFLKSSLNIIDCVAILPFYLEVGLSGLSSKAAKDVLGFLRVVRFVRILRIFKLTRHFVGLRVLGHTLRASTNEFLLLIIFLALGVLIFATMIYYAERIGADPDDILGSNHTYFKNIPIGFWWAVVTMTTLGYGDMYPKTWSGMLVGALCALAGVLTIAMPVPVIVNNFGMYYSLAMAKQKLPKKKNKHIPRPPQPGSPNYCKPDPPPPPPPHPHHGSGGISPPPPITPPSMGVTVAGAYPAGPHTHPGLLRGGAGGLGIMGLPPLPAPGEPCPLAQEEVIEINRADPRPNGDPAAAALAHEDCPAIDQPAMSPEDKSPITPGSRGRYSRDRACFLLTDYAPSPDGSIRKATGAPPLPPQDWRKPGPPSFLPDLNANAAAWISP

SEQ ID NO: 58798 - protein, 635 aa, Homo sapiens
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAACFLLSTGDYACADGSVRKGTFVLRDLPLQHSPEAACPPTAGTLFLPH

SEQ ID NO: 58799 - protein, 626 aa, Homo sapiens
MISSVCVSSYRGRKSGNKPPSKTCLKEEMAKGEASEKIIINVGGTRHETYRSTLRTLPGTRLAWLADPDGGGRPETDGGGVGSSGSSGGGGCEFFFDRHPGVFAYVLNYYRTGKLHCPADVCGPLFEEELTFWGIDETDVEPCCWMTYRQHRDAEEALDIFESPDGGGSGAGPSDEAGDDERELALQRLGPHEGGAGHGAGSGGCRGWQPRMWALFEDPYSSRAARVVAFASLFFILVSITTFCLETHEAFNIDRNVTEILRVGNITSVHFRREVETEPILTYIEGVCVLWFTLEFLVRIVCCPDTLDFVKNLLNIIDFVAILPFYLEVGLSGLSSKAARDVLGFLRVVRFVRILRIFKLTRHFVGLRVLGHTLRASTNEFLLLIIFLALGVLIFATMIYYAERIGARPSDPRGNDHTDFKNIPIGFWWAVVTMTTLGYGDMYPKTWSGMLVGALCALAGVLTIAMPVPVIVNNFGMYYSLAMAKQKLPKKRKKHVPRPAQLESPMYCKSEETSPRDSTCSDTSPPAREEGMIERKRADSKQNGDANAVLSDEEGAGLTQPLASSPTPEERRALRRSTTRDRNKKAAACFLLSTGDYACADGSVRKETCQDALSSNYAQAEVLTLS

SEQ ID NO: 58800 - protein, 635 aa, Homo sapiens; identical to SEQ ID NO: 58798

SEQ ID NO: 58801 - protein, 494 aa, Homo sapiens
MDGSGERSLPEPGSQSSAASDDIEIVVNVGGVRQVLYGDLLSQYPETRLAELINCLAGGYDTIFSLCDDYDPGKREFYFDRDPDAFKCVIEVYYFGEVHMKKGICPICFKNEMDFWKVDLKFLDDCCKSHLSEKREELEEIARRVQLILDDLGVDAAEGRWRRCQKCVWKFLEKPESSCPARVVAVLSFLLILVSSVVMCMGTIPELQVLDAEGNRVEHPTLENVETACIGWFTLEYLLRLFSSPNKLHFALSFMNIVDVLAILPFYVSLTLTHLGARMMELTNVQQAVQALRIMRIARIFKLARHSSGLQTLTYALKRSFKELGLLLMYLAVGIFVFSALGYTMEQSHPETLFKSIPQSFWWAIITMTTVGYGDIYPKTTLGKLNAAISFLCGVIAIALPIHPIINNFVRYYNKQRVLETAAKHELELMELNSSSGGEGKTGGSRSDLDNLPPEPAGKEAPSCSSRLKLSHSDTFIPLLTEEKHHRTRLQSCK

SEQ ID NO: 58802 - protein, 513 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQGHCSQMCHNVFIVESVCVGWFSLEFLLRLIQAPSKFAFLRSPLTLIDLVAILPYYITLLVDGAAAGRRKPGAGNSYLDKVGLVLRVLRALRILYVMRLARHSLGLQTLGLTARRCTREFGLLLLFLCVAIALFAPLLYVIENEMADSPEFTSIPACYWWAVITMTTVGYGDMVPRSTPGQVVALSSILSGILLMAFPVTSIFHTFSRSYLELKQEQERVMFRRAQFLIKTKSQLSVSQDSDILFGSASSDTRDNN

SEQ ID NO: 58803 - protein, 275 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQVRAHAPRGNAPPRGKGL

SEQ ID NO: 58804 - protein, 180 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMV

SEQ ID NO: 58805 - protein, 96 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACT

SEQ ID NO: 58806 - protein, 258 aa, Homo sapiens
MTLLPGDNSDYDYSALSCTSDASFHPAFLPQRQAIKGAFYRRAQRLRPQDEPRQGCQPEDRRRRIIINVGGIKYSLPWTTLDEFPLTRLGQLKACTNFDDILNVCDDYDVTCNEFFFDRNPGAFGTILTFLRAGKLRLLREMCALSFQEELLYWGIAEDHLDGCCKRRYLQKIEEFAEMVEREEEDDALDSEGRDSEGPAEGEGRLGRCMRRLRDMVERPHSGLPGKVFACLSVLFVTVTAVNLSVSTLPSLREEEEQ

SEQ ID NO: 58807 - protein, 48 aa, Homo sapiens
MTLLPGDNSDYDYSALSCTSDASFHPAFLPQRQAIKGAFYRRAQRLRP

SEQ ID NO: 58808 - protein, 436 aa, Homo sapiens
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRYSAGPGREPSGIIEAICIGWFTAECIVRFIVSKNKCEFVKRPLNIIDLLAITPYYISVLMTVFTGENSQLQRAGVTLRVLRMMRIFWVIKLARHFIGLQTLGLTLKRCYREMVMLLVFICVAMAIFSALSQLLEHGLDLETSNKDFTSIPAACWWVIISMTTVGYGDMYPITVPGRILGGVCVVSGIVLLALPITFIYHSFVQCYHELKFRSARYSRSLSTEFLN

SEQ ID NO: 58809 - protein, 425 aa, Homo sapiens
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRIIEAICIGWFTAECIVRFIVSKNKCEFVKRPLNIIDLLAITPYYISVLMTVFTGENSQLQRAGVTLRVLRMMRIFWVIKLARHFIGLQTLGLTLKRCYREMVMLLVFICVAMAIFSALSQLLEHGLDLETSNKDFTSIPAACWWVIISMTTVGYGDMYPITVPGRILGGVCVVSGIVLLALPITFIYHSFVQCYHELKFRSARYSRSLSTEFLN

SEQ ID NO: 58810 - protein, 519 aa, Homo sapiens
MPMPSRDGGLHPRHHHYGSHSPWSQLLSSPMETPSIKGLYYRRVRKVGALDASPVDLKKEILINVGGRRYLLPWSTLDRFPLSRLSKLRLCRSYEEIVQLCDDYDEDSQEFFFDRSPSAFGVIVSFLAAGKLVLLQEMCALSFQEELAYWGIEEAHLERCCLRKLLRKLEELEELAKLHREDVLRQQRETRRPASHSSRWGLCMNRLREMVENPQSGLPGKVFACLSILFVATTAVSLCVSTMPDLRAEEDQGECSRKCYYIFIVETICVAWFSLEFCLRFVQAQDKCQFFQGPLNIIDILAISPYYVSLAVSEEPPEDGERPSGSSYLEKVGLVLRVLRALRILYVMRLARHSLGLQTLGLTVRRCTREFGLLLLFLAVAITLFSPLVYVAEKESGRVLEFTSIPASYWWAIISMTTVGYGDMVPRSVPGQMVALSSILSGILIMAFPATSIFHTFSHSYLELKKEQEQLQARLRHLQNTGPASECELLDPHVASEHELMNDVNDLILEGPALPIMHM

SEQ ID NO: 58811 - protein, 989 aa, Homo sapiens
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEVSAFMGDPGKIGFADQIPPPLEGRESQGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 58812 - protein, 962 aa, Homo sapiens
MTMAGGRRGLVAPQNTFLENIVRRSNDTNFVLGNAQIVDWPIVYSNDGFCKLSGYHRAEVMQKSSTCSFMYGELTDKDTIEKVRQTFENYEMNSFEILMYKKNRTPVWFFVKIAPIRNEQDKVVLFLCTFSDITAFKQPIEDDSCKGWGKFARLTRALTSSRGVLQQLAPSVQKGENVHKHSRLAEVLQLGSDILPQYKQEAPKTPPHIILHYCVFKTTWDWIILILTFYTAILVPYNVSFKTRQNNVAWLVVDSIVDVIFLVDIVLNFHTTFVGPAGEVISDPKLIRMNYLKTWFVIDLLSCLPYDVINAFENVDEGISSLFSSLKVVRLLRLGRVARKLDHYIEYGAAVLVLLVCVFGLAAHWMACIWYSIGDYEIFDEDTKTIRNNSWLYQLAMDIGTPYQFNGSGSGKWEGGPSKNSVYISSLYFTMTSLTSVGFGNIAPSTDIEKIFAVAIMMIGSLLYATIFGNVTTIFQQMYANTNRYHEMLNSVRDFLKLYQVPKGLSERVMDYIVSTWSMSRGIDTEKVLQICPKDMRADICVHLNRKVFKEHPAFRLASDGCLRALAMEFQTVHCAPGDLIYHAGESVDSLCFVVSGSLEVIQDDEVVAILGKGDVFGDVFWKEATLAQSCANVRALTYCDLHVIKRDALQKVLEFYTAFSHSFSRNLILTYNLRKRIVFRKISDVKREEEERMKRKNEAPLILPPDHPVRRLFQRFRQQKEARLAAERGGRDLDDLDVEKGNVLTEHASANHSLVKASVVTVRESPATPVSFQAASTSGVPDHAKLQAPGSECLGPKGGGGDCAKRKSWARFKDACGKSEDWNKVSKAESMETLPERTKASGEATLKKTDSCDSGITKSDLRLDNVGEARSPQDRSPILAEVKHSFYPIPEQTLQATVLEVRHELKEDIKALNAKMTNIEKQLSEILRILTSRRSSQSPQELFEISRPQSPESERDIFGAS

SEQ ID NO: 58813 - protein, 1159 aa, Homo sapiens
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 58814 - protein, 819 aa, Homo sapiens
MAAPAGKASRTGALRPRAQKGRVRRAVRISSLVAQEVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 58815 - protein, 393 aa, Homo sapiens
MAAPAGKASRTGALRPRAQKGRVRRAVRISSLVAQEVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQCCDHPGAWPHFHIPAVARQPPPHPHLGLAFSGFPVHGV

SEQ ID NO: 58816 - protein, 1063 aa, Homo sapiens
MSSHSAGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGKNDIFGEPLNLYARPGKSNGDVRALTYCDLHKIHRDDLLEVLDMYPEFSDHFWSSLEITFNLRDTNMIPGSPGSTELEGGFSRQRKRKLSFRRRTDKDTEQPGEVSALGPGRAGAGPSSRGRPGGPWGESPSSGPSSPESSEDEGPGRSSSPLRLVPFSSPRPPGEPPGGEPLMEDCEKSSDTCNPLSGAFSGVSNIFSFWGDSRGRQYQELPRCPAPTPSLLNIPLSSPGRRPRGDVESRLDALQRQLNRLETRLSADMATVLQLLQRQMTLVPPAYSAVTTPGPGPTSTSPLLPVSPLPTLTLDSLSQVSQFMACEELPPGAPELPQEGPTRRLSLPGQLGALTSQPLHRHGSDPGS

SEQ ID NO: 58817 - protein, 888 aa, Homo sapiens
MPVRRGHVAPQNTFLDTIIRKFEGQSRKFIIANARVENCAVIYCNDGFCELCGYSRAEVMQRPCTCDFLHGPRTQRRAAAQIAQALLGAEERKVEIAFYRKDGSCFLCLVDVVPVKNEDGAVIMFILNFEVVMEKDMVGSPAHDTNHRGPPTSWLAPGRAKTFRLKLPALLALTARESSVRSGGAGGAGAPGAVVVDVDLTPAAPSSESLALDEVTAMDNHVAGLGPAEERRALVGPGSPPRSAPGQLPSPRAHSLNPDASGSSCSLARTRSRESCASVRRASSADDIEAMRAGVLPPPPRHASTGAMHPLRSGLLNSTSDSDLVRYRTISKIPQITLNFVDLKGDPFLASPTSDREIIAPKIKERTHNVTEKVTQVLSLGADVLPEYKLQAPRIHRWTILHYSPFKAVWDWLILLLVIYTAVFTPYSAAFLLKETEEGPPATECGYACQPLAVVDLIVDIMFIVDILINFRTTYVNANEEVVSHPGRIAVHYFKGWFLIDMVAAIPFDLLIFGSGSEELIGLLKTARLLRLVRVARKLDRYSEYGAAVLFLLMCTFALIAHWLACIWYAIGNMEQPHMDSRIGWLHNLGDQIGKPYNSSGLGGPSIKDKYVTALYFTFSSLTSVGFGNVSPNTNSEKIFSICVMLIGSLMYASIFGNVSAIIQRLYSGTARYHTQMLRVREFIRFHQIPNPLRQRLEEYFQHAWSYTNGIDMNAVLKGFPECLQADICLHLNRSLLQHCKPFRGATKGCLRALAMKFKTTHAPPGDTLVHAGDLLTALYFISRGSIEILRGDVVVAILGMGWGAGTGLEMPSAASRGASLLNMQSLGLWTWDCLQGHWAPLIHLNSGPPSGAMERSPTWGEAAELWGSHILLPFRIRHKQTLFASLK

SEQ ID NO: 58818 - protein, 1083 aa, Homo sapiens
MPAMRGLLAPQNTFLDTIATRFDGTHSNFVLGNAQVAGLFPVVYCSDGFCDLTGFSRAEVMQRGCACSFLYGPDTSELVRQQIRKALDEHKEFKAELILYRKSGLPFWCLLDVIPIKNEKGEVALFLVSHKDISETKNRGGPDRWKETGGGRRRYGRARSKGFNANRRRSRAVLYHLSGHLQKQPKGKHKLNKGVFGEKPNLPEYKVAAIRKSPFILLHCGALRATWDGFILLATLYVAVTVPYSVCVSTAREPSAARGPPSVCDLAVEVLFILDIVLNFRTTFVSKSGQVVFAPKSICLHYVTTWFLLDVIAALPFDLLHAFKVNVYFGAHLLKTVRLLRLLRLLPRLDRYSQYSAVVLTLLMAVFALLAHWVACVWFYIGQREIESSESELPEIGWLQELARRLETPYYLVGRRPAGGNSSGQSDNCSSSSEANGTGLELLGGPSLRSAYITSLYFALSSLTSVGFGNVSANTDTEKIFSICTMLIGALMHAVVFGNVTAIIQRMYARRFLYHSRTRDLRDYIRIHRIPKPLKQRMLEYFQATWAVNNGIDTTELLQSLPDELRADIAMHLHKEVLQLPLFEAASRGCLRALSLALRPAFCTPGEYLIHQGDALQALYFVCSGSMEVLKGGTVLAILGKGDLIGCELPRREQVVKANADVKGLTYCVLQCLQLAGLHDSLALYPEFAPRFSRGLRGELSYNLGAGGGSAEVDTSSLSGDNTLMSTLEEKETDGEQGPTVSPAPADEPSSPLLSPGCTSSSSAAKLLSPRRTAPRPRLGGRGRPGRAGALKAEAGPSAPPRALEGLRLPPMPWNVPPDLSPRVVDGIEDGCGSDQPKFSFRVGQSGPECSSSPSPGPESGLLTVPHGPSEARNTDTLDKLRQAVTELSEQVLQMREGLQSLRQAVQLVLAPHREGPCPRASGEGPCPASTSGLLQPLCVDTGASSYCLQPPAGSVLSGTWPHPRPGPPPLMAPWPWGPPASQSSPWPRATAFWTSTSDSEPPASGDLCSEPSTPASPPPSEEGARTGPAEPVSQAEATSTGEPPPGSGGLALPWDPHSLEMVLIGCHGSGTVQWTQEEGTGV

SEQ ID NO: 58819 - protein, 988 aa, Homo sapiens
MPGGKRGLVAPQNTFLENIVRRSSESSFLLGNAQIVDWPVVYSNDGFCKLSGYHRADVMQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGSLLYATIFGNVTTIFQQMYANTNRYHEMLNNVRDFLKLYQVPKGLSERVMDYIVSTWSMSKGIDTEKVLSICPKDMRADICVHLNRKVFNEHPAFRLASDGCLRALAVEFQTIHCAPGDLIYHAGESVDALCFVVSGSLEVIQDDEVVAILGKGDVFGDIFWKETTLAHACANVRALTYCDLHIIKREALLKVLDFYTAFANSFSRNLTLTCNLRKRIIFRKISDVKKEEEERLRQKNEVTLSIPVDHPVRKLFQKFKQQKELRNQGSTQGDPERNQLQVESRSLQNGASITGTSVVTVSQITPIQTSLAYVKTSESLKQNNRDAMELKPNGGADQKCLKVNSPIRMKNGNGKGWLRLKNNMGAHEEKKEDWNNVTKAESMGLLSEDPKSSDSENSVTKNPLRKTDSCDSGITKSDLRLDKAGEARSPLEHSPIQADAKHPFYPIPEQALQTTLQEVKHELKEDIQLLSCRMTALEKQVAEILKILSEKSVPQASSPKSQMPLQVPPQIPCQDIFSVSRPESPESDKDEIHF

SEQ ID NO: 58820 - protein, 422 aa, Homo sapiens
MQKSSTCSFMYGELTDKKTIEKVRQTFDNYESNCFEVLLYKKNRTPVWFYMQIAPIRNEHEKVVLFLCTFKDITLFKQPIEDDSTKGWTKFARLTRALTNSRSVLQQLTPMNKTEVVHKHSRLAEVLQLGSDILPQYKQEAPKTPPHIILHYCAFKTTWDWVILILTFYTAIMVPYNVSFKTKQNNIAWLVLDSVVDVIFLVDIVLNFHTTFVGPGGEVISDPKLIRMNYLKTWFVIDLLSCLPYDIINAFENVDEGISSLFSSLKVVRLLRLGRVARKLDHYLEYGAAVLVLLVCVFGLVAHWLACIWYSIGDYEVIDEVTNTIQIDSWLYQLALSIGTPYRYNTSAGIWEGGPSKDSLYVSSLYFTMTSLTTIGFGNIAPTTDVEKMFSVAMMMVGCKYFNFFIENYCYWQFSWLQSQIG

SEQ ID NO: 58821 - protein, 732 aa, Homo sapiens
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVCMSVFQNESAAGIIVIAKME

SEQ ID NO: 58822 - protein, 1196 aa, Homo sapiens
MPVRRGHVAPQNTFLGTIIRKFEGQNKKFIIANARVQNCAIIYCNDGFCEMTGFSRPDVMQKPCTCDFLHGPETKRHDIAQIAQALLGSEERKVEVTYYHKNGSTFICNTHIIPVKNQEGVAMMFIINFEYVTDNENAATPERVNPILPIKTVNRKFFGFKFPGLRVLTYRKQSLPQEDPDVVVIDSSKHSDDSVAMKHFKSPTKESCSPSEADDTKALIQPSKCSPLVNISGPLDHSSPKRQWDRLYPDMLQSSSQLSHSRSRESLCSIRRASSVHDIEGFGVHPKNIFRDRHASEDNGRNVKGPFNHIKSSLLGSTSDSNLNKYSTINKIPQLTLNFSEVKTEKKNSSPPSSDKTIIAPKVKDRTHNVTEKVTQVLSLGADVLPEYKLQTPRINKFTILHYSPFKAVWDWLILLLVIYTAIFTPYSAAFLLNDREEQKRRECGYSCSPLNVVDLIVDIMFIIDILINFRTTYVNQNEEVVSDPAKIAIHYFKGWFLIDMVAAIPFDLLIFGSGSDETTTLIGLLKTARLLRLVRVARKLDRYSEYGAAVLMLLMCIFALIAHWLACIWYAIGNVERPYLTDKIGWLDSLGQQIGKRYNDSDSSSGPSIKDKYVTALYFTFSSLTSVGFGNVSPNTNSEKIFSICVMLIGSLMYASIFGNVSAIIQRLYSGTARYHMQMLRVKEFIRFHQIPNPLRQRLEEYFQHAWTYTNGIDMNMVLKGFPECLQADICLHLNQTLLQNCKAFRGASKGCLRALAMKFKTTHAPPGDTLVHCGDVLTALYFLSRGSIEILKDDIVVAILGKNDIFGEMVHLYAKPGKSNADVRALTYCDLHKIQREDLLEVLDMYPEFSDHFLTNLELTFNLRHESAKADLLRSQSMNDSEGDNCKLRRRKLSFESEGEKENSTNDPEDSADTIRHYQSSKRHFEEKKSRSSSFISSIDDEQKPLFSGIVDSSPGIGKASGLDFEETVPTSGRMHIDKRSHSCKDITDMRSWERENAHPQPEDSSPSALQRAAWGISETESDLTYGEVEQRLDLLQEQLNRLESQMTTDIQTILQLLQKQTTVVPPAYSMVTAGSEYQRPIIQLMRTSQPEASIKTDRSFSPSSQCPEFLDLEKSKLKSKESLSSGVHLNTASEDNLTSLLKQDSDLSLELHLRQRKTYVHPIRHPSLPDSSLSTVGIVGLHRHVSDPGLPGK

SEQ ID NO: 58823 - protein, 584 aa, Homo sapiens
MVAEVCSMPTASTVKKPFDLRSKMGKWCHHRFPCCRGSGKSNMGTSGDHDDSFMKMLRSKMGKCCRHCFPCCRGSGTSNVGTSGDHENSFMKMLRSKMGKWCCHCFPCCRGSGKSNVGAWGDYDHSAFMEPRYHIRREDLDKLHRAAWWGKVPRKDLIVMLRDTDMNKRDKEKRTALHLASANGNSEVVQLLLDRRCQLNVLDNKKRTALIKAIQCQEDECVLMLLEHGADRNIPDEYGNTALHYAIYNEDKLMAKALLLYGADIESKNKCGLTPLLLGVHEQKQQVVKFLIKKKANLNVLDRYGRTALILAVCCGSASIVNLLLEQNVDVSSQDLSGQTAREYAVSSHHHVICELLSDYKEKQMLKISSENSNPEQDLKLTSEEESQRLKVSENSQPEKMSQEPEINKDCDREVEEEIKKHGSNPVGLPENLTNGASAGNGDDGLIPQRRSRKPENQQFPDTENEEYHSDEQNDTRKQLSEEQNTGISQDEILTNKQKQIEVAEQKMNSELSLSHKKEEDLLRENSVLQEEIAMLRLELDETKHQNQLRENKILEEIESVKEKTDKLLRAMQLNEEALTKTNI

SEQ ID NO: 58824 - protein, 545 aa, Homo sapiens
MVAEAGSMPAASSVKKPFGLRSKMGKWCRHCFAWCRGSGKSNVGTSGDHDDSAMKTLRSKMGKWCCHCFPWCRGSGKSNVGTSGDHDDSAMKTLRSKMGKWCCHCFPCCRGSGKSNVGTSGDHDDSAMKTLRSKMGKWCCHCFPCCRGSGKNKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLTNGATADNGDDGLIPPRKSRTPESQQFPDTENEQYHSDEQNDTQKQLSEEQNTGILQDEILIHEEKQIEVAENEF

SEQ ID NO: 58825 - protein, 288 aa, Homo sapiens
MVAEAGSMPAASSVKKPFGLRSKMGKWCRHCFAWCRGSGKSNVGTSGDHDDSAMKTLRSKMGKWCCHCFPWCRGSGKSNVGTSGDHDDSAMKTLRSKMGKWCCHCFPCCRGSGKSNVGTSGDHDDSAMKTLRSKMGKWCCHCFPCCRGSGKNKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNED

SEQ ID NO: 58826 - protein, 508 aa, Homo sapiens
MVAEAGSMPAASSVKKPFGLRSKMGKWCRHCFAWCRGSGKSNVGTSGDHDDSAMKTLRSKMGKWCCHCFPWCRGSGKSNVGTSGDHDDSAMKTLRSKMGKWCCHCFPCCRGSGKNKVGPWGDYDDSAFMEPRYHVRREDLDKLHRAAWWGKVPRKDLIVMLKDTDMNKKDKQKRTALHLASANGNSEVVKLLLDRRCQLNILDNKKRTALTKAVQCQEDECALMLLEHGTDPNIPDEYGNTALHYAIYNEDKLMAKALLLYGADIESKNKHGLTPLLLGVHEQKQQVVKFLIKKKANLNALDRYGRTALILAVCCGSASIVSLLLEQNIDVSSQDLSGQTAREYAVSSRHNVICQLLSDYKEKQILKVSSENSNPEQDLKLTSEEESQRLKGSENSQPEEMSQEPEINKGGDRKVEEEMKKHGSTHMGFPENLTNGATADNGDDGLIPPRKSRTPESQQFPDTENEQYHSDEQNDTQKQLSEEQNTGILQDEILIHEEKQIEVAENEF

SEQ ID NO: 58827 - protein, 317 aa, Homo sapiens
MSCQAFTSADTFIPLNSDASATLPLIMHHSAAECLPVSNHATNVMSTVPSILSLIQTPKCLCTHFSVTTLGNTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLGYTQTNVGEALAAVHGSEFSQTTICRFENLQLSFKNACKLKAILSKWLEEAEQVGALYNEKVGANERKRKRRTTISIAAKDALERHFGEQNKPSSQEIMRMAEELNLEKEVVRVWFCNRRQREKRVKTSLNQSLFSISKEHLECR

SEQ ID NO: 58828 - protein, 291 aa, Homo sapiens
MSCQAFTSADTFIPLNSDASATLPLIMHHSAAECLPVSNHATNVMSTATGLHYSVPSCHYGNQPSTYGVMAGSLTPCLYKFPDHTLSHGFPPIHQPLLAEDPTAADFKQELRRKSKLVEEPIDMDSPEIRELEKFANEFKVRRIKLGYTQTNVGEALAAVHGSEFSQTTICRFENLQLSFKNACKLKAILSKWLEEAEQVGALYNEKVGANERKRKRRTTISIAAKDALERHFGEQNKPSSQEIMRMAEELNLEKEVVRVWFCNRRQREKRVKTSLNQSLFSISKEHLECR

SEQ ID NO: 58829 - protein, 256 aa, Homo sapiens
MLWQKPTAPEQAPAPARPYQGVRVKEPVKELLRRKRGHASSGAAPAPTAVVLPHQPLATYTTVGPSCLDMEGSVSAVTEEAALCAGWLSQPTPATLQPLAPWTPYTEYVPHEAVSCPYSADMYVQPVCPSYTVVGPSSVLTYASPPLITNVTTRSSATPAVGPPLEGPEHQAPLTYFPWPQPLSTLPTSTLQYQPPAPALPGPQFVQLPISIPEPVLQDMEDPRRAASSLTIDKLLLEEEDSDAYALNHTLSVEGF

SEQ ID NO: 58830 - protein, 479 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 58831 - protein, 602 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGSTMVGLSSGLSPALMSNNPLATIQALASGGTLPLTSLDGSGNLVLGAAGAAPGSPGLVTSPLFLNHAGLPLLSTPPGVGLVSAAAAAVAASISSKSPGLSSSSSSSSSSSSSTCSETAAQTPGGPGGPEAGSKPE

SEQ ID NO: 58832 - protein, 463 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 58833 - protein, 474 aa, Homo sapiens
MGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGPGLWWNPAPYQP

SEQ ID NO: 58834 - protein, 400 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTAQTPALKAATRLSACQA

SEQ ID NO: 58835 - protein, 467 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQAVTRPTLPDPHLSHPQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTG

SEQ ID NO: 58836 - protein, 586 aa, Homo sapiens
MVHSSMGAPEIRMSKPLEAEKQGLDSPSEHTDTERNGPDTNHQNPQNKTSPFSVSPTGPSTKIKAEDPSGDSAPAAPLPPQPAQPHLPQAQLMLTGSQLAGDIQQLLQLQQLVLVPGHHLQPPAQFLLPQAQQSQPGLLPTPNLFQLPQQTQGALLTSQPRAGLPTQPPKCLEPPSHPEEPSDLEELEQFARTFKQRRIKLGFTQGDVGLAMGKLYGNDFSQTTISRFEALNLSFKNMCKLKPLLEKWLNDAETMSVDSSLPSPNQLSSPSLGFDGLPGRRRKKRTSIETNVRFALEKSFLANQKPTSEEILLIAEQLHMEKEVIRVWFCNRRQKEKRINPCSAAPMLPSPGKPASYSPHMVTPQGGAGTLPLSQASSSLSTTVTTLSSAVGTLHPSRTAGGGGGGGGAAPPLNSIPSVTPPPPATTNSTNPSPQGSHSAIGLSGLNPSTGSTMVGLSSGLSPALMSNNPLATIQALASGGTLPLTSLDGSGNLVLGAAGAAPGSPGLVTSPLFLNHAGLPLLSTPPGVGLVSAAAAAVAASISSKSPGLSSSSSSSSSSSSSTCSETAAQTPGGPGGPEAGSKPE

SEQ ID NO: 58837 - protein, 436 aa, Homo sapiens
MVNLESMHTDIKMSGDVADSTDARSTLSQVEPGNDRNGLDFNRQIKTEDLSDSLQQTLSHRPCHLSQGPAMMSGNQMSGLNASPCQDMASLHPLQQLVLVPGHLQSVSQFLLSQTQPGQQGLQPNLLPFPQQQSGLLLPQTGPGLASQAFGHPGLPGSSLEPHLEASQHLPVPKHLPSSGGADEPSDLEELEKFAKTFKQRRIKLGFTQGDVGLAMGKLYGNDFSQTTISRFEALNLSFKNMCKLKPLLEKWLNDAESSPSDPSVSTPSSYPSLSEVFGRKRKKRTSIETNIRLTLEKRFQDNPKPSSEEISMIAEQLSMEKEVVRVWFCNRRQKEKRINCPVATPIKPPVYNSRLVSPSGSLGPLSVPPVHSTMPGTVTSSCSPGNNSRPSSPGSGLHASSPTASQNNSKAAVNSASSFNSSGSWYRWNHSTYLH

SEQ ID NO: 58838 - protein, 438 aa, Homo sapiens
MESPRTAKGGRDIKMSGDVADSTDARSTLSQVEPGNDRNGLDFNRQIKTEDLSDSLQQTLSHRPCHLSQGPAMMSGNQMSGLNASPCQDMASLHPLQQLVLVPGHLQSVSQFLLSQTQPGQQGLQPNLLPFPQQQSGLLLPQTGPGLASQAFGHPGLPGSSLEPHLEASQHLPVPKHLPSSGGADEPSDLEELEKFAKTFKQRRIKLGFTQGDVGLAMGKLYGNDFSQTTISRFEALNLSFKNMCKLKPLLEKWLNDAESSPSDPSVSTPSSYPSLSEVFGRKRKKRTSIETNIRLTLEKRFQDNPKPSSEEISMIAEQLSMEKEVVRVWFCNRRQKEKRINCPVATPIKPPVYNSRLVSPSGSLGPLSVPPVHSTMPGTVTSSCSPGNNSRPSSPGSGLHASSPTASQNNSKAAVNSASSFNSSGSWYRWNHSTYLH

SEQ ID NO: 58839 - protein, 451 aa, Homo sapiens
MATTAQYLPRGPGGGAGGTGPLMHPDAAAAAAAAAAAERLHAGAAYREVQKLMHHEWLGAGAGHPVGLAHPQWLPTGGGGGGDWAGGPHLEHGKAGGGGTGRADDGGGGGGFHARLVHQGAAHAGAAWAQGSTAHHLGPAMSPSPGASGGHQPQPLGLYAQAAYPGGGGGGLAGMLAAGGGGAGPGLHHALHEDGHEAQLEPSPPPHLGAHGHAHGHAHAGGLHAAAAHLHPGAGGGGSSVGEHSDEDAPSSDDLEQFAKQFKQRRIKLGFTQADVGLALGTLYGNVFSQTTICRFEALQLSFKNMCKLKPLLNKWLEETDSSSGSPTNLDKIAAQGRKRKKRTSIEVGVKGALESHFLKCPKPSAHEITGLADSLQLEKEVVRVWFCNRRQKEKRMTPAAGAGHPPMDDVYAPGELGPGGGGASPPSAPPPPPPAALHHHHHHTLPGSVQ

SEQ ID NO: 58840 - protein, 443 aa, Homo sapiens
MATAASNHYSLLTSSASIVHAEPPGGMQQGAGGYREAQSLVQGDYGALQSNGHPLSHAHQWITALSHGGGGGGGGGGGGGGGGGGGGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPSFTVNGMLGAGGQPAGLHHHGLRDAHDEPHHADHHPHPHSHPHQQPPPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 58841 - protein, 376 aa, Homo sapiens
MATAASNHYSLLTSSASIVHAEPPGGMQQGAGGYREAQSLVQGDYGALQSNGHPLSHAHQWITALSHGGDGSPWSTSPLGQPDIKPSVVVQQGGRGDELHGPGALQQQHQQQQQQQQQQQQQQQQQQQQQRPPHLVHHAANHHPGPGAWRSAAAAAHLPPSMGASNGGLLYSQPPPPPQGPPGHPGAHHDPHSDEDTPTSDDLEQFAKQFKQRRIKLGFTQADVGLALGTLYGNVFSQTTICRFEALQLSFKNMCKLKPLLNKWLEEADSSSGSPTSIDKIAAQGRKRKKRTSIEVSVKGALESHFLKCPKPSAQEITSLADSLQLEKEVVRVWFCNRRQKEKRMTPPGGTLPGAEDVYGGSRDTPPHHGVQTPVQ

SEQ ID NO: 58842 - protein, 500 aa, Homo sapiens
MATAASNPYLPGNSLLAAGSIVHSDAAGAGGGGGGGGGGGGGGAGGGGGGMQPGSAAVTSGAYRGDPSSVKMVQSDFMQGAMAASNGGHMLSHAHQWVTALPHAAAAAAAAAAAAVEASSPWSGSAVGMAGSPQQPPQPPPPPPQGPDVKGGAGRDDLHAGTALHHRGPPHLGPPPPPPHQGHPGGWGAAAAAAAAAAAAAAAAHLPSMAGGQQPPPQSLLYSQPGGFTVNGMLSAPPGPGGGGGGAGGGAQSLVHPGLVRGDTPELAEHHHHHHHHAHPHPPHPHHAQGPPHHGGGGGGAGPGLNSHDPHSDEDTPTSDDLEQFAKQFKQRRIKLGFTQADVGLALGTLYGNVFSQTTICRFEALQLSFKNMCKLKPLLNKWLEEADSSTGSPTSIDKIAAQGRKRKKRTSIEVSVKGALESHFLKCPKPSAQEITNLADSLQLEKEVVRVWFCNRRQKEKRMTPPGIQQQTPDDVYSQVGTVSADTPPPHHGLQTSVQ

SEQ ID NO: 58843 - protein, 361 aa, Homo sapiens
MATAASNPYSILSSTSLVHADSAGMQQGSPFRNPQKLLQSDYLQGVPSNGHPLGHHWVTSLSDGGPWSSTLATSPLDQQDVKPGREDLQLGAIIHHRSPHVAHHSPHTNHPNAWGASPAPNPSITSSGQPLNVYSQPGFTVSGMLEHGGLTPPPAAASAQSLHPVLREPPDHGELGSHHCQDHSDEETPTSDELEQFAKQFKQRRIKLGFTQADVGLALGTLYGNVFSQTTICRFEGLQLSFKNMCKLKPLLNKWLEEADSSTGSPTSIDKIAAQGRKRKKRTSIEVSVKGVLETHFLKCPKPAAQEISSLADSLQLEKEVVRVWFCNRRQKEKRMTPPGDQQPHEVYSHTVKTDTSCHDL

SEQ ID NO: 58844 - protein, 419 aa, Homo sapiens
MMSMNSKQPHFAMHPTLPEHKYPSLHSSSEAIRRACLPTPPLQSNLFASLDETLLARAEALAAVDIAVSQGKSHPFKPDATYHTMNSVPCTSTSTVPLAHHHHHHHHHQALEPGDLLDHISSPSLALMAGAGGAGAAAGGGGAHDGPGGGGGPGGGGGPGGGPGGGGGGGPGGGGGGPGGGLLGGSAHPHPHMHSLGHLSHPAAAAAMNMPSGLPHPGLVAAAAHHGAAAAAAAAAAGQVAAASAAAAVVGAAGLASICDSDTDPRELEAFAERFKQRRIKLGVTQADVGSALANLKIPGVGSLSQSTICRFESLTLSHNNMIALKPILQAWLEEAEGAQREKMNKPELFNGGEKKRKRTSIAAPEKRSLEAYFAVQPRPSSEKIAAIAEKLDLKKNVVRVWFCNQRQKQKRMKFSATY

SEQ ID NO: 58845 - protein, 338 aa, Homo sapiens
MMAMNSKQPFGMHPVLQEPKFSSLHSGSEAMRRVCLPAPQLQGNIFGSFDESLLARAEALAAVDIVSHGKNHPFKPDATYHTMSSVPCTSTSSTVPISHPAALTSHPHHAVHQGLEGDLLEHISPTLSVSGLGAPEHSVMPAQIHPHHLGAMGHLHQAMGMSHPHTVAPHSAMPACLSDVESDPRELEAFAERFKQRRIKLGVTQADVGAALANLKIPGVGSLSQSTICRFESLTLSHNNMIALKPVLQAWLEEAEAAYREKNSKPELFNGSERKRKRTSIAAPEKRSLEAYFAIQPRPSSEKIAAIAEKLDLKKNVVRVWFCNQRQKQKRMKYSAVH

SEQ ID NO: 58846 - protein, 265 aa, Homo sapiens
MHFYRLFLGATRRFLNPEWKGEIDNWCVYVLTSLLPFKIQSQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 58847 - protein, 360 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVGLTLGVLFGKVFSQTTICRFEALQLSFKNMCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 58848 - protein, 123 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVETPMGPPRSPAPHPFPFPLL

SEQ ID NO: 58849 - protein, 185 aa, Homo sapiens
MAGHLASDFAFSPPPGGGGDGPGGPEPGWVDPRTWLSFQGPPGGPGIGPGVGPGSEVWGIPPCPPPYEFCGGMAYCGPQVGVGLVPQGGLETSQPEGEAGVGVESNSDGASPEPCTVTPGAVKLEKEKLEQNPEESQDIKALQKELEQFAKLLKQKRITLGYTQADVHPGGSIWEGIQPNDHLPL

SEQ ID NO: 58850 - protein, 185 aa, Homo sapiens; identical to SEQ ID NO: 58849

SEQ ID NO: 58851 - protein, 164 aa, Homo sapiens
MCKLRPLLQKWVEEADNNENLQEICKAETLVQARKRKRTSIENRVRGNLENLFLQCPKPTLQQISHIAQQLGLEKDVVRVWFCNRRQKGKRSSSDYAQREDFEAAGSPFSGGPVSFPLAPGPHFGTPGYGSPHFTALYSSVPFPEGEAFPPVSVTTLGSPMHSN

SEQ ID NO: 58852 - protein, 164 aa, Homo sapiens; identical to SEQ ID NO: 58851

SEQ ID NO: 58853 - protein, 691 aa, Homo sapiens
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRHTILRSHFFLPQEAQENTIASSLTAKLNPGLLYPARFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 58854 - protein, 655 aa, Homo sapiens
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHSHSQNQNQPSPTQQSSSPPQKPSQSPGHGLPSPLTPPNPLQLVNNPLASQAAAAAAAMSSIASSQAFGNALSSLQGVTGQLVTNAQGQIIGTIPLMPNPGPSSQAASGTQGLQVQPITPQLLTNAQGQIIATVIGNQILPVINTQGITLSPIKPGQQLHQPSQTSVGQAASQGNLLHLAHSQASMSQSPVRQASSSSSSSSSSSALSVGQLVSNPQTAAGEVDGVNLEEIREFAKAFKIRRLSLGLTQTQVGQALSATEGPAYSQSAICRFEKLDITPKSAQKIKPVLERWMAEAEARHRAGMQNLTEFIGSEPSKKRKRRTSFTPQALEILNAHFEKNTHPSGQEMTEIAEKLNYDREVVRVWFCNKRQALKNTIKRLKQHEPATAVPLEPLTDSLEENS

SEQ ID NO: 58855 - protein, 691 aa, Homo sapiens
MEKIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 58856 - protein, 789 aa, Homo sapiens
MKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 58857 - protein, 825 aa, Homo sapiens
MLDICLEKRVGTTLAAPKCNSSTVRFQGLAEGTKGTMKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPHPMLNPTSLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 58858 - protein, 63 aa, Homo sapiens
MKMDMEDADMTLWTEAEFEEKCTYIVNDHPWDSGADGGTSVQAEASLPRNLLFKYATNSEEVI

SEQ ID NO: 58859 - protein, 788 aa, Homo sapiens
MKMDMEDADMTLWTEAEFEEKCTYIVNDHPWDSGADGGTSVQAEASLPRNLLFKYATNSEEVIGVMSKEYIPKGTRFGPLIGEIYTNDTVPKNANRKYFWRIYSRGELHHFIDGFNEEKSNWMRYVNPAHSPREQNLAACQNGMNIYFYTIKPIPANQELLVWYCRDFAERLHYPYPGELTMMNLTQTQSSLKQPSTEKNELCPKNVPKREYSVKEILKLDSNPSKGKDLYRSNISPLTSEKDLDDFRRRGSPEMPFYPRVVYPIRAPLPEDFLKASLAYGIERPTYITRSPIPSSTTPSPSARSSPDQSLKSSSPHSSPGNTVSPVGPGSQEHRDSYAYLNASYGTEGLGSYPGYAPLPHLPPAFIPSYNAHYPKFLLPPYGMNCNGLSAVSSMNGINNFGLFPRLCPVYSNLLGGGSLPTPCSTPLLPSSLPSDGARRLLQPEHPREVLVPAPHSAFSFTGAAASMKDKACSPTSGSPTAGTAATAEHVVQPKATSAAMAAPSSDEAMNLIKNKRNMTGYKTLPYPLKKQNGKIKYECNVCAKTFGQLSNLKVHLRVHSGERPFKCQTCNKGFTQLAHLQKHYLVHTGEKPHECQVCHKRFSSTSNLKTHLRLHSGEKPYQCKVCPAKFTQFVHLKLHKRLHTRERPHKCSQCHKNYIHLCSLKVHLKGNCAAAPAPGLPLEDLTRINEEIEKFDISDNADRLEDVEDDISVISVVEKEILAVVRKEKEETGLKVSLQRNMGNGLLSSGCSLYESSDLPLMKLPPSNPLPLVPVKVKQETVEPMDP

SEQ ID NO: 58860 - protein, 571 aa, Homo sapiens
MALPRPSEAVPQDKVCYPPESSPQNLAAYYTPFPSYGHYRNSLATVEEDFQPFRQLEAAASAAPAMPPFPFRMAPPLLSPGLGLQREPLYDLPWYSKLPPWYPIPHVPREVPPFLSSSHEYAGASSEDLGHQIIGGDNESGPCCGPDTLIPPPPADASLLPEGLRTSQLLPCSPSKQSEDGPKPSNQEGKSPARFQFTEEDLHFVLYGVTPSLEHPASLHHAISGLLVPPDSSGSDSLPQTLDKDSLQLPEGLCLMQTVFGEVPHFGVFCSSFIAKGVRFGPFQGKVVNASEVKTYGDNSVMWEIFEDGHLSHFIDGKGGTGNWMSYVNCARFPKEQNLVAVQCQGHIFYESCKEIHQNQELLVWYGDCYEKFLDIPVSLQVTEPGKQPSGPSEESAEGYRCERCGKVFTYKYYRDKHLKYTPCVDKGDRKFPCSLCKRSFEKRDRLRIHILHVHEKHRPHKCSTCGKCFSQSSSLNKHMRVHSGDRPYQCVYCTKRFTASSILRTHIRQHSGEKPFKCKYCGKSFASHAAHDSHVRRSHKEDDGCSCSICGKIFSDQETFYSHMKFHEDY

SEQ ID NO: 58861 - protein, 100 aa, Homo sapiens
MALPRPSEAVPQDKVCYPPESSPQNLAAYYTPFPSYGHYRNSLATVEEDFQPFRQLEAAASAAPAMPPFPFRMAPPLLSPGLGLQREPLYDLPWYSKLPP

SEQ ID NO: 58862 - protein, 1276 aa, Homo sapiens
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYSRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 58863 - protein, 1276 aa, Homo sapiens
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQVIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 58864 - protein, 1092 aa, Homo sapiens
FCAYSAKIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYSRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 58865 - protein, 1275 aa, Homo sapiens
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 58866 - protein, 1256 aa, Homo sapiens
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQGSLDAWLKVTGATSESGAFHPINHL

SEQ ID NO: 58867 - protein, 1084 aa, Homo sapiens
IYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQAYAMMLSLSEDTPLHTPSQGSLDAWLKVTGATSESGAFHPINHL

SEQ ID NO: 58868 - protein, 1257 aa, Homo sapiens
MRSKARARKLAKSDGDVVNNMYEPNRDLLASHSAEDEAEDSAMSPIPVGPPSPFPTSEDFTPKEGSPYEAPVYIPEDIPIPADFELRESSIPGAGLGVWAKRKMEAGERLGPCVVVPRAAAKETDFGWEQILTDVEVSPQEGCITKISEDLGSEKFCVDANQAGAGSWLKYIRVACSCDDQNLTMCQISEQIYYKVIKDIEPGEELLVHVKEGVYPLGTVPPGLDEEPTFRCDECDELFQSKLDLRRHKKYTCGSVGAALYEGLAEELKPEGLGGGSGQAHECKDCERMFPNKYSLEQHMVIHTEEREYKCDQCPKAFNWKSNLIRHQMSHDSGKRFECENCVKVFTDPSNLQRHIRSQHVGARAHACPDCGKTFATSSGLKQHKHIHSTVKPFICEVCHKSYTQFSNLCRHKRMHADCRTQIKCKDCGQMFSTTSSLNKHRRFCEGKNHYTPGGIFAPGLPLTPSPMMDKAKPSPSLNHASLGFNEYFPSRPHPGSLPFSTAPPTFPALTPGFPGIFPPSLYPRPPLLPPTSLLKSPLNHTQDAKLPSPLGNPALPLVSAVSNSSQGTTAAAGPEEKFESRLEDSCVEKLKTRSSDMSDGSDFEDVNTTTGTDLDTTTGTGSDLDSDVDSDPDKDKGKGKSAEGQPKFGGGLAPPGAPNSVAEVPVFYSQHSFFPPPDEQLLTATGAAGDSIKAIASIAEKYFGPGFMGMQEKKLGSLPYHSAFPFQFLPNFPHSLYPFTDRALAHNLLVKAEPKSPRDALKVGGPSAECPFDLTTKPKDVKPILPMPKGPSAPASGEEQPLDLSIGSRARASQNGGGREPRKNHVYGERKLGAGEGLPQVCPARMPQQPPLHYAKPSPFFMDPIYSRVEKRKVTDPVGALKEKYLRPSPLLFHPQMSAIETMTEKLESFAAMKADSGSSLQPLPHHPFNFRSPPPTLSDPILRKGKERYTCRYCGKIFPRSANLTRHLRTHTGEQPYRCKYCDRSFSISSNLQRHVRNIHNKEKPFKCHLCNRCFGQQTNLDRHLKKHEHENAPVSQHPGVLTNHLGTSASSPTSESDNHALLDEKEDSYFSEIRNFIANSEMNQASTRTEKRADMQIVDGSAQCPGLASEKQEDVEEEDDDDLEEDDEDSLAGKSQDDTVSPAPEPQAAYEDEEDEEPAASLAVGFDHTRRCAEDHEGGLLALEPMPTFGKGLDLRRAAEEAFEVKDVLNSTLDSEALKHTLCRQAKNQGSLDAWLKVTGATSESGAFHPINHL

SEQ ID NO: 58869 - protein, 801 aa, Homo sapiens
MHHRMNEMNLSPVGMEQLTSSSVSNALPVSGSHLGLAASPTHSAIPAPGLPVAIPNLGPSLSSLPSALSLMLPMGIGDRGVMCGLPERNYTLPPPPYPHLESSYFRTILPGILSYLADRPPPQYIHPNSINVDGNTALSITNNPSALDPYQSNGNVGLEPGIVSIDSRSVNTHGAQSLHPSDGHEVALDTAITMENVSRVTSPISTDGMAEELTMDGVAGEHSQIPNGSRSHEPLSVDSVSNNLAADAVGHGGVIPMHGNGLELPVVMETDHIASRVNGMSDSALSDSIHTVAMSTNSVSVALSTSHNLASLESVSLHEVGLSLEPVAVSSITQEVAMGTGHVDVSSDSLSFVSPSLQMEDSNSNKENMATLFTIWCTLCDRAYPSDCPEHGPVTFVPDTPIESRARLSLPKQLVLRQSIVGAEVGVWTGETIPVRTCFGPLIGQQSHSMEVAEWTDKAVNHIWKIYHNGVLEFCIITTDENECNWMMFVRKARNREEQNLVAYPHDGKIFFCTSQDIPPENELLFYYSRDYAQQIGVPEHPDVHLCNCGKECNSYTEFKAHLTSHIHNHLPTQGHSGSHGPSHSKERKWKCSMCPQAFISPSKLHVHFMGHMGMKPHKCDFCSKAFSDPSNLRTHLKIHTGQKNYRCTLCDKSFTQKAHLESHMVIHTGEKNLKCDYCDKLFMRRQDLKQHVLIHTQERQIKCPKCDKLFLRTNHLKKHLNSHEGKRDYVCEKCTKAYLTKYHLTRHLKTCKGPTSSSSAPEEEEEDDSEEEDLADSVGTEDCRINSAVYSADESLSAHK

SEQ ID NO: 58870 - protein, 75 aa, Homo sapiens
MHHRMNEMNLSPVGMEQLTSSSVSNALPVSGSHLGLAASPTHSAIPAPGLPVAIPNLGPSLSSLPSALSLMLPMG

SEQ ID NO: 58871 - protein, 630 aa, Homo sapiens
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQEGENIFYLAVEDIETDTELLIGYLDSDMEAEEEEQQIMTVIKEGEVENSRRQSTAGRKDRLGCKEDYACPQCESSFTSEDILAEHLQTLHQKPTEEKEFKCKNCGKKFPVKQALQRHVLQCTAKSSLKESSRSFQCSVCNSSFSSASSFEQHQETCRGDARFVCKADSCGKRLKSKDALKRHQENVHTGDPKKKLICSVCNKKCSSASSLQEHRKIHEIFDCQECMKKFISANQLKRHMITHSEKRPYNCEICNKSFKRLDQVGAHKVIHSEDKPYKCKLCGKGFAHRNVYKNHKKTHSEERPFQCEECKALFRTPFSLQRHLLIHNSERTFKCHHCDATFKRKDTLNVHVQVVHERHKKYRCELCNKAFVTPSVLRSHKKTHTGEKEKICPYCGQKFASSGTLRVHIRSHTGERPYQCPYCEKGFSKNDGLKMHIRTHTREKPYKCSECSKAFSQKRGLDEHKRTHTGEKPFQCDVCDLAFSLKKMLIRHKMTHNPNRPLAECQFCHKKFTRNDYLKVHMDNIHGVADS

SEQ ID NO: 58872 - protein, 111 aa, Homo sapiens
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQDKNLGPAEWRG

SEQ ID NO: 58873 - protein, 599 aa, Homo sapiens
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQEGENIFYLAVEDIETDTELLIGYLDSDMEAEEEEQQIMTVIKEGEVENSRRQSTAGRKDRLGCKEDYACPQCESSFTSEDILAEHLQTLHQKPTEEKEFKCKNCGKKFPVKQALQRHFEQHQETCRGDARFVCKADSCGKRLKSKDALKRHQENVHTGDPKKKLICSVCNKKCSSASSLQEHRKIHEIFDCQECMKKFISANQLKRHMITHSEKRPYNCEICNKSFKRLDQVGAHKVIHSEDKPYKCKLCGKGFAHRNVYKNHKKTHSEERPFQCEECKALFRTPFSLQRHLLIHNSERTFKCHHCDATFKRKDTLNVHVQVVHERHKKYRCELCNKAFVTPSVLRSHKKTHTGEKEKICPYCGQKFASSGTLRVHIRSHTGERPYQCPYCEKGFSKNDGLKMHIRTHTREKPYKCSECSKAFSQKRGLDEHKRTHTGEKPFQCDVCDLAFSLKKMLIRHKMTHNPNRPLAECQFCHKKFTRNDYLKVHMDNIHGVADS

SEQ ID NO: 58874 - protein, 501 aa, Homo sapiens
MLGMYVPDRFSLKSSRVQDGMGLYTARRVRKGEKFGPFAGEKRMPEDLDENMDYRLMWEVRGSKGEVLYILDATNPRHSNWLRFVHEAPSQEQKNLAAIQEGENIFYLAVEDIETDTELLIGYLDSDMEAEEEEQQIMTVIKEGEVENSRRQSTAGRKDRLGCKEDYACPQCESSFTSEDILAEHLQTLHQKPTEEKEFKCKNCGKKFPVKQALQRHFEQHQETCRGDARFVCKADSCGKRLKSKDALKRHQENVHTGDPKKKLICSVCNKKCSSASSLQEHRKIHEIFDCQECMKKFISANQLKRHMITHSEKRPYNCEICNKSFKRLDQVGAHKVIHSEDKPYKCKLCGKGFAHRNVYKNHKKTHSEERPFQCEECKALFRTPFSLQRHLLIHNSERTFKCHHCDATFKRKDTLNVHVQVVHERHKKYRCELCNKAFVTPSVLRSHKKTHTGEKEKICPYCGQKFASSGTLRVHIRSHTGEAVQVLRVQQGLQPEARPG

SEQ ID NO: 58875 - protein, 408 aa, Homo sapiens
MCQNFFIDSCAAHGPPTFVKDSAVDKGHPNRSALSLPPGLRIGPSGIPQAGLGVWNEASDLPLGLHFGPYEGRITEDEEAANNGYSWLITKGRNCYEYVDGKDKSWANWMRYVNCARDDEEQNLVAFQYHRQIFYRTCRVIRPGCELLVWYGDEYGQELGIKWGSKWKKELMAGREPKPEIHPCPSCCLAFSSQKFLSQHVERNHSSQNFPGPSARKLLQPENPCPGDQNQEQQYPDPHSRNDKTKGQEIKERSKLLNKRTWQREISRAFSSPPKGQMGSCRVGKRIMEEESRTGQKVNPGNTGKLFVGVGISRIAKVKYGECGQGFSVKSDVITHQRTHTGEKPYVCRECGRGFSWQSVLLTHQRTHTGEKPYVCRECGRGFSRQSVLLTHQRTHTGEKPYVCREDE

SEQ ID NO: 58876 - protein, 894 aa, Homo sapiens
MSPEKSQEESPEEDTERTERKPMVKDAFKDISIYFTKEEWAEMGDWEKTRYRNVKRNYNALITIGLRATRPAFMCHRRQAIKLQVDDTEDSDEEWTPRQQVKPPWMALRVEQRKHQKGMPKASFSNESSLKELSRTANLLNASGSEQAQKPVSPSGEASTSGQHSRLKLELRKKETERKMYSLRERKGHAYKEVSEPQDDDYLYCEMCQNFFIDSCAAHGPPTFVKDSAVDKGHPNRSALSLPPGLRIGPSGIPQAGLGVWNEASDLPLGLHFGPYEGRITEDEEAANNGYSWLITKGRNCYEYVDGKDKSWANWMRYVNCARDDEEQNLVAFQYHRQIFYRTCRVIRPGCELLVWYGDEYGQELGIKWGSKWKKELMAGREPKPEIHPCPSCCLAFSSQKFLSQHVERNHSSQNFPGPSARKLLQPENPCPGDQNQEQQYPDPHSRNDKTKGQEIKERSKLLNKRTWQREISRAFSSPPKGQMGSCRVGKRIMEEESRTGQKVNPGNTGKLFVGVGISRIAKVKYGECGQGFSVKSDVITHQRTHTGEKLYVCRECGRGFSWKSHLLIHQRIHTGEKPYVCRECGRGFSWQSVLLTHQRTHTGEKPYVCRECGRGFSRQSVLLTHQRRHTGEKPYVCRECGRGFSRQSVLLTHQRRHTGEKPYVCRECGRGFSWQSVLLTHQRTHTGEKPYVCRECGRGFSWQSVLLTHQRTHTGEKPYVCRECGRGFSNKSHLLRHQRTHTGEKPYVCRECGRGFRDKSHLLRHQRTHTGEKPYVCRECGRGFRDKSNLLSHQRTHTGEKPYVCRECGRGFSNKSHLLRHQRTHTGEKPYVCRECGRGFRNKSHLLRHQRTHTGEKPYVCRECGRGFSDRSSLCYHQRTHTGEKPYVCREDE

SEQ ID NO: 58877 - protein, 100 aa, Homo sapiens
MSPEKSQEESPEEDTERTERKPMVKDAFKDISIYFTKEEWAEMGDWEKTRYRNVKRNYNALITIGLRATRPAFMCHRRQAIKLQVDDTEDSDEEWTPRQQ

SEQ ID NO: 58878 - protein, 178 aa, Homo sapiens
MSEVRLPPLRALDDFVLGSARLAAPDPCDPQRWCHRVINNLLYYQTNYLLCFGIGLALAGYVRPLHTLLSALVVAVALGVLVWAAETRAAVRRCRRSHPAACLAAVLAVGLLVLWVAGGACTFLFSIAGPVLLILVHASLRLRNLKNKIENKIESIGLKRTPMGLLLEALGQEQEAGS

SEQ ID NO: 58879 - protein, 281 aa, Homo sapiens
MAGTWLLLLLALGCPALPTGVGGTPFPSLAPPIMLLVDGKQQMVVVCLVLDVAPPGLDSPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 58880 - protein, 127 aa, Homo sapiens
MAATSPGPWVSSPTHRSCFLPFLTRGCHNRVWAAHPFLLWPHQSCCWWMESSRWWWSAWSLMLHPLALTAPGRKPGSPVWGEGSYLSSYPTCPAQAWCSRSALRAPSSSLGAFFAGDLPPPLQAGAA

SEQ ID NO: 58881 - protein, 256 aa, Homo sapiens
MAGTWLLLLLALGCPALPTGPVSFPSSPEAATTGPIWFSAGNGSALDAFTYGPSPATDGTWTNLAHLSLPSEELASWEPLVCHTGPGAEGHSRSTQPMHLSGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 58882 - protein, 174 aa, Homo sapiens
MAGTWLLLLLALGCPALPTGEASTARTCPQEPLRGTPGGALWLGVLRLLLFKLLLFDLLLTCSCLCDPAGPLPSPATTTRLRALGSHRLHPATETGGREATSSPRPQPRDRRWGDTPPGRKPGSPVWGEGSYLSSYPTCPAQAWCSRSALRAPSSSLGAFFAGDLPPPLQAGAA

SEQ ID NO: 58883 - protein, 145 aa, Homo sapiens
MSWAPVLLMLFVYCTGCGPQPVLHQPPAMSSALGTTIRLTCTLRNDHDIGVYSVYWYQQRPGHPPRFLLRYFSQSDKSQGPQVPPRFSGSKDVARNRGYLSISELQPEDEAMYYCAMGARSSEKEEREREWEEEMEPTAARTRVP

SEQ ID NO: 58884 - protein, 123 aa, Homo sapiens
MACRCLSFLLMGTFLSVSQTVLAQLDALLVFPGQVAQLSCTLSPQHVTIRDYGVSWYQQRAGSAPRYLLYYRSEEDHHRPADIPDRFSAAKDEAHNACVLTISPVQPEDDADYYCSVGYGFSP

SEQ ID NO: 58885 - protein, 170 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQ

SEQ ID NO: 58886 - protein, 347 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGGYPSPCYQPDRRIQ

SEQ ID NO: 58887 - protein, 347 aa, Homo sapiens; identical to SEQ ID NO: 58886

SEQ ID NO: 58888 - protein, 430 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 58889 - protein, 325 aa, Homo sapiens
MRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 58890 - protein, 370 aa, Homo sapiens
MLLVFFVLWTCSLALLASSQSPPPPCASVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISANGGWQDATTPSSVTSPTEGPGSVHSDTSN

SEQ ID NO: 58891 - protein, 420 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISHLPRHPRQAHYHFRLPTWHP

SEQ ID NO: 58892 - protein, 301 aa, Homo sapiens
MRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVSNWFGNKRIRYKKNIGKFQEEANIYAAKTAVTATNVSAHGSQANSPSTPNSAGSSSSFNMSNSGDLFMSVQSLNGDSYQGAQVGANVQSQVDTLRHVISQTGGYSDGLAASQMYSPQGISEIARTY

SEQ ID NO: 58893 - protein, 339 aa, Homo sapiens
MDEQPRLMHSHAGVGMAGHPGLSQHLQDGAGGTEGEGGRKQDIGDILQQIMTITDQSLDEAQARKHALNCHRMKPALFNVLCEIKEKTVLSIRGAQEEEPTDPQLMRLDNMLLAEGVAGPEKGGGSAAAAAAAAASGGAGSDNSVEHSDYRAKLSQIRQIYHTELEKYEQACNEFTTHVMNLLREQSRTRPISPKEIERMVSIIHRKFSSIQMQLKQSTCEAVMILRSRFLDARRKRRNFNKQATEILNEYFYSHLSNPYPSEEAKEELAKKCGITVSQVDTLRHVISQTGGYSDGLAASQMYSPQGISANGGWQDATTPSSVTSPTEGPGSVHSDTSN

SEQ ID NO: 58894 - protein, 325 aa, Homo sapiens; identical to SEQ ID NO: 58889

SEQ ID NO: 58895 - protein, 325 aa, Homo sapiens; identical to SEQ ID NO: 58889

SEQ ID NO: 58896 - protein, 430 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 58897 - protein, 430 aa, Homo sapiens; identical to SEQ ID NO: 58896

SEQ ID NO: 58898 - protein, 430 aa, Homo sapiens; identical to SEQ ID NO: 58896

SEQ ID NO: 58899 - protein, 430 aa, Homo sapiens; identical to SEQ ID NO: 58896

SEQ ID NO: 58900 - protein, 430 aa, Homo sapiens; identical to SEQ ID NO: 58896

SEQ ID NO: 58901 - protein, 430 aa, Homo sapiens; identical to SEQ ID NO: 58896

SEQ ID NO: 58902 - protein, 430 aa, Homo sapiens; identical to SEQ ID NO: 58896

SEQ ID NO: 58903 - protein, 463 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVLWRLREELSGKVHASQLGAVVSNWFGNKRIRYKKNIGKFQEEANIYAVKTAVIIAERGPFGVRGTELSLPSLPPQGSGGSFNLSGSGDMFLGMPGLNGDSYSASQVRCPSPLQVESLRHSMGPGGYGDNLGGGQMYSPREMRANGSWQEAVTPSSVTSPTEGPGSVHSDTSN

SEQ ID NO: 58904 - protein, 463 aa, Homo sapiens; identical to SEQ ID NO: 58903

SEQ ID NO: 58905 - protein, 438 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVRCPSPLQVESLRHSMGPGGYGDNLGGGQMYSPREMRANGSWQEAVTPSSVTSPTEGPGSVHSDTSN

SEQ ID NO: 58906 - protein, 438 aa, Homo sapiens; identical to SEQ ID NO: 58905

SEQ ID NO: 58907 - protein, 463 aa, Homo sapiens; identical to SEQ ID NO: 58903

SEQ ID NO: 58908 - protein, 463 aa, Homo sapiens; identical to SEQ ID NO: 58903

SEQ ID NO: 58909 - protein, 443 aa, Homo sapiens
GAEQGGGLRAPPQLWTNGYWGRPLQAGAGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVSNWFGNKRIRYKKNIGKFQEEANIYAVKTAVSVTQGGHSRTSSPTPPSSAGSGGSFNLSGSGDMFLGMPGLNGDSYSASQVESLRHSMGPGGYGDNLGGGQMYSPREMRANGSWQEAVTPSSVTSPTEGPGSVHSDTSN

SEQ ID NO: 58910 - protein, 443 aa, Homo sapiens; identical to SEQ ID NO: 58909

SEQ ID NO: 58911 - protein, 438 aa, Homo sapiens; identical to SEQ ID NO: 58905

SEQ ID NO: 58912 - protein, 459 aa, Homo sapiens
MDERLLGPPPPGGGRGGLGLVSGEPGGPGEPPGGGDPGGGSGGVPGGRGKQDIGDILQQIMTITDQSLDEAQAKKHALNCHRMKPALFSVLCEIKEKTGLSIRSSQEEEPVDPQLMRLDNMLLAEGVAGPEKGGGSAAAAAAAAASGGGVSPDNSIEHSDYRSKLAQIRHIYHSELEKYEQACNEFTTHVMNLLREQSRTRPVAPKEMERMVSIIHRKFSAIQMQLKQSTCEAVMILRSRFLDARRKRRNFSKQATEVLNEYFYSHLSNPYPSEEAKEELAKKCGITVSQVLWRLREELSGKVHASQLGAVVSNWFGNKRIRYKKNIGKFQEEANIYAVKTAVSVTQGGHSRTSSPTPPSSAGSGGSFNLSGSGDMFLGMPGLNGDSYSASQVRCPSPLQVESLRHSMGPGGYGDNLGGGQMYSPREMRANGSWQEAVTPSSVTSPTEGPGSVHSDTSN

SEQ ID NO: 58913 - protein, 443 aa, Homo sapiens; identical to SEQ ID NO: 58909

SEQ ID NO: 58914 - protein, 438 aa, Homo sapiens; identical to SEQ ID NO: 58905

SEQ ID NO: 58915 - protein, 438 aa, Homo sapiens; identical to SEQ ID NO: 58905

SEQ ID NO: 58916 - protein, 443 aa, Homo sapiens; identical to SEQ ID NO: 58909

SEQ ID NO: 58917 - protein, 463 aa, Homo sapiens; identical to SEQ ID NO: 58903

SEQ ID NO: 58918 - protein, 443 aa, Homo sapiens; identical to SEQ ID NO: 58909

SEQ ID NO: 58919 - protein, 443 aa, Homo sapiens; identical to SEQ ID NO: 58909

SEQ ID NO: 58920 - protein, 351 aa, Homo sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGGYPPSCYQSDGRLQ

SEQ ID NO: 58921 - protein, 253 aa, Homo sapiens
MNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 58922 - protein, 455 aa, Homo sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQSLVKDPKERGSKGSDIQPTSVVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 58923 - protein, 434 aa, Homo sapiens
MDDQSRMLQTLAGVNLAGHSVQGGMALPPPPHGHEGADGDGRKQDIGDILHQIMTITDQSLDEAQAKKHALNCHRMKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 58924 - protein, 262 aa, Homo sapiens
MRGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGGYPPSCYQSDGRLQ

SEQ ID NO: 58925 - protein, 359 aa, Homo sapiens
MKPALFSVLCEIKEKTGLSIRGAQEEDPPDPQLMRLDNMLLAEGVSGPEKGGGSAAAAAAAAASGGSSDNSIEHSDYRAKLTQIRQIYHTELEKYEQACNEFTTHVMNLLREQSRTRPISPKEIERMVGIIHRKFSSIQMQLKQSTCEAVMILRSRFLDARRKRRNFSKQATEILNEYFYSHLSNPYPSEEAKEELAKKCSITVSQVSNWFGNKRIRYKKNIGKFQEEANLYAAKTAVTAAHAVAAAVQNNQTNSPTTPNSGSSGSFNLPNSGDMFMNMQSLNGDSYQGSQVGANVQSQVDTLRHVINQTGGYSDGLGGNSLYSPHNLNANGGWQDATTPSSVTSPTEGPGSVHSDTSN

SEQ ID NO: 58926 - protein, 509 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 58927 - protein, 509 aa, Homo sapiens; identical to SEQ ID NO: 58926

SEQ ID NO: 58928 - protein, 509 aa, Homo sapiens; identical to SEQ ID NO: 58926

SEQ ID NO: 58929 - protein, 86 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVL

SEQ ID NO: 58930 - protein, 509 aa, Homo sapiens; identical to SEQ ID NO: 58926

SEQ ID NO: 58931 - protein, 115 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPR

SEQ ID NO: 58932 - protein, 152 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAA

SEQ ID NO: 58933 - protein, 493 aa, Homo sapiens
MSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKRKKNVLRLCCKKLKIFAMPMQDIKMILKMVQLDSIEDLEVTCTWKLPTLAKFSPYLGQMINLRRLLLSHIHASSYISPEKEEQYIAQFTSQFLSLQCLQALYVDSLFFLRGRLDQLLRHVMNPLETLSITNCRLSEGDVMHLSQSPSVSQLSVLSLSGVMLTDVSPEPLQALLERASATLQDLVFDECGITDDQLLALLPSLSHCSQLTTLSFYGNSISISALQSLLQHLIGLSNLTHVLYPVPLESYEDIHGTLHLERLAYLHARLRELLCELGRPSMVWLSANPCPHCGDRTFYDPEPILCPCFMPN

SEQ ID NO: 58934 - protein, 201 aa, Homo sapiens
MERRRLWGSIQSRYISMSVWTSPRRLVELAGQSLLKDEALAIAALELLPRELFPPLFMAAFDGRHSQTLKAMVQAWPFTCLPLGVLMKGQHLHLETFKAVLDGLDVLLAQEVRPRRWKLQVLDLRKNSHQDFWTVWSGNRASLYSFPEPEAAQPMTKKRKVDGLSTEAEQPFIPVEVLVDLFLKEGACDELFSYLIEKVKR

SEQ ID NO: 58935 - protein, 493 aa, Homo sapiens; identical to SEQ ID NO: 58933

SEQ ID NO: 58936 - protein, 509 aa, Homo sapiens; identical to SEQ ID NO: 58926

SEQ ID NO: 58937 - protein, 122 aa, Homo sapiens
MAAPVDLELKKAFTELQAKVIDTQQKVKLADIQIEQLNRTKKHAHLTDTEIMTLVDETNMYEGVGRMFILQSKEAIHSQLLEKQKIAEEKIKELEQKKSYLERSVKEAEDNIREMLMARRAQ

SEQ ID NO: 58938 - protein, 154 aa, Homo sapiens
MAENSGRAGKSSGSGAGKGAVSAEQVIAGFNRLRQEQRGLASKAAELEMELNEHSLVIDTLKEVDETRKCYRMVGGVLVERTVKEVLPALENNKEQIQKIIETLTQQLQAKGKELNEFREKHNIRLMGEDEKPAAKENSEGAGAKASSAGVLVS

SEQ ID NO: 58939 - protein, 134 aa, Homo sapiens
MAATMKKAAAEDVNVTFEDQQKINKFARNTSRITELKEEIEVKKKQLQNLEDACDDIMLADDDCLMIPYQIGDVFISHSQEETQEMLEEAKKNLQEEIDALESRVESIQRVLADLKVQLYAKFGSNINLEADES

SEQ ID NO: 58940 - protein, 154 aa, Homo sapiens
MAQSINITELNLPQLEMLKNQLDQEVEFLSTSIAQLKVVQTKYVEAKDCLNVLNKSNEGKELLVPLTSSMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 58941 - protein, 109 aa, Homo sapiens
MAQSINITELNLPQLEMLKNQLDQMYVPGKLHDVEHVLIDVGTGYYVEKTAEDAKDFFKRKIDFLTKQMEKIQPALQEKHAMKQAVMEMMSQKIQQLTALGAAQATAKA

SEQ ID NO: 58942 - protein, 154 aa, Homo sapiens; identical to SEQ ID NO: 58940

SEQ ID NO: 58943 - protein, 426 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSGKWIPASLAIGF

SEQ ID NO: 58944 - protein, 143 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLH

SEQ ID NO: 58945 - protein, 428 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSAYSSSINYTSGNRN

SEQ ID NO: 58946 - protein, 419 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSDWTVP

SEQ ID NO: 58947 - protein, 417 aa, Homo sapiens
MGTLSAPPCTQRIKWKGLLLTASLLNFWNLPTTAQVTIEAEPTKVSEGKDVLLLVHNLPQNLTGYIWYKGQMRDLYHYITSYVVDGEIIIYGPAYSGRETAYSNASLLIQNVTREDAGSYTLHIIKGDDGTRGVTGRFTFTLHLETPKPSISSSNLNPRETMEAVSLTCDPETPDASYLWWMNGQSLPMTHSLKLSETNRTLFLLGVTKYTAGPYECEIRNPVSASRSDPVTLNLLPKLPKPYITINNLNPRENKDVLNFTCEPKSENYTYIWWLNGQSLPVSPRVKRPIENRILILPSVTRNETGPYQCEIRDRYGGIRSDPVTLNVLYGPDLPRIYPSFTYYRSGEVLYLSCSADSNPPAQYSWTINEKFQLPGQKLFIRHITTKHSGLYVCSVRNSATGKESSKSMTVEVSEAL

SEQ ID NO: 58948 - protein, 213 aa, Homo sapiens
MGPLSAPPCTEHIKWKGLLLTVETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 58949 - protein, 335 aa, Homo sapiens
MGPLSAPPCTEHIKWKGLLLTALLLNFWNLPTTAQVMIEAQPPKVSEGKDVLLLVHNLPQNLTGYIWYKGQIRDLYHYITSYVVDGQIIIYGPAYSGRETVYSNASLLIQNVTREDAGSYTLHIIKRGDGTRGVTGYFTFTLYLETPKPSISSSNLNPREAMETVILTCNPETPDASYLWWMNGQSLPMTHRMQLSETNRTLFLFGVTKYTAGPYECEIWNSGSASRSDPVTLNLLHGPDLPRIFPSVTSYYSGENLDLSCFANSNPPAQYSWTINGKFQLSGQKLFIPQITPKHNGLYACSARNSATGEESSTSLTIRVIAPPGLGTFAFNNPT

SEQ ID NO: 58950 - protein, 335 aa, Homo sapiens; identical to SEQ ID NO: 58949

SEQ ID NO: 58951 - protein, 213 aa, Homo sapiens; identical to SEQ ID NO: 58948

SEQ ID NO: 58952 - protein, 335 aa, Homo sapiens
MGPLSAPPCTEHIKWKGLLVTASLLNFWNLPTTAQVTIEAQPPKVSEGKDVLLLVHNLPQNLTGYIWYKGQIRDLYHYITSYVVDGQIIIYGPAYSGRETAYSNASLLIQNVTREDAGSYTLHIIKRGDGTRGVTGYFTFTLYLETPKPSISSSNLNPREAMETVILTCDPETPDTSYQWWMNGQSLPMTHRFQLSETNRTLFLFGVTKYTAGPYECEIRNSGSASRSDPVTLNLLHGPDLPRIHPSYTNYRSGDNLYLSCFANSNPPAQYSWTINGKFQQSGQNLFIPQITTKHSGLYVCSVRNSATGEESSTSLTVKVSASTRIGLLPLLNPT

SEQ ID NO: 58953 - protein, 335 aa, Homo sapiens; identical to SEQ ID NO: 58952

SEQ ID NO: 58954 - protein, 335 aa, Homo sapiens; identical to SEQ ID NO: 58952

SEQ ID NO: 58955 - protein, 428 aa, Homo sapiens
MGPLSAPPCTQRITWKGLLLTALLLNFWNLPTTAQVTIEAEPTKVSKGKDVLLLVHNLPQNLAGYIWYKGQMKDLYHYITSYVVDGQIIIYGPAYSGRETVYSNASLLIQNVTREDAGSYTLHIVKRGDGTRGETGHFTFTLYLETPKPSISSSNLYPREDMEAVSLTCDPETPDASYLWWMNGQSLPMTHSLQLSKNKRTLFLFGVTKYTAGPYECEIRNPVSASRSDPVTLNLLPKLPKPYITINNLNPRENKDVLAFTCEPKSENYTYIWWLNGQSLPVSPRVKRPIENRILILPSVTRNETGPYQCEIQDRYGGIRSYPVTLNVLYGPDLPRIYPSFTYYHSGENLYLSCFADSNPPAEYSWTINGKFQLSGQKLFIPQITTKHSGLYACSVRNSATGMESSKSMTVKVSAPSGTGHLPGLNPL

SEQ ID NO: 58956 - protein, 326 aa, Homo sapiens
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLHGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 58957 - protein, 419 aa, Homo sapiens
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHLETPKPSISSSNLNPREAMEAVILTCDPATPAASYQWWMNGQSLPMTHRLQLSKTNRTLFIFGVTKYIAGPYECEIRNPVSASRSDPVTLNLLPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 58958 - protein, 326 aa, Homo sapiens
MGPLSAPPCTQRITWKGVLLTASLLNFWNPPTTAQVTIEAQPPKVSEGKDVLLLVHNLPQNLAGYIWYKGQMTYLYHYITSYVVDGQRIIYGPAYSGRERVYSNASLLIQNVTQEDAGSYTLHIIKRRDGTGGVTGHFTFTLHPKLSKPYITINNLNPRENKDVLTFTCEPKSKNYTYIWWLNGQSLPVSPRVKRPIENRILILPNVTRNETGPYQCEIRDRYGGIRSDPVTLNVLYGPDLPSIYPSFTYYRSGENLYLSCFAESNPRAQYSWTINGKFQLSGQKLSIPQITTKHSGLYACSVRNSATGKESSKSITVKVSDWILP

SEQ ID NO: 58959 - protein, 335 aa, Homo sapiens
MGPLSAPPCTQHITWKGLLLTASLLNFWNLPITAQVTIEALPPKVSEGKDVLLLVHNLPQNLAGYIWYKGQLMDLYHYITSYVVDGQINIYGPAYTGRETVYSNASLLIQNVTREDAGSYTLHIIKRGDRTRGVTGYFTFNLYLKLPKPYITINNSKPRENKDVLAFTCEPKSENYTYIWWLNGQSLPVSPRVKRPIENRILILPSVTRNETGPYECEIRDRDGGMRSDPVTLNVLYGPDLPSIYPSFTYYRSGENLYLSCFAESNPPAEYFWTINGKFQQSGQKLSIPQITTKHRGLYTCSVRNSATGKESSKSMTVEVSAPSGIGRLPLLNPI

SEQ ID NO: 58960 - protein, 335 aa, Homo sapiens; identical to SEQ ID NO: 58959

SEQ ID NO: 58961 - protein, 335 aa, Homo sapiens; identical to SEQ ID NO: 58959

SEQ ID NO: 58962 - protein, 424 aa, Homo sapiens
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSGPCHGNQTESH

SEQ ID NO: 58963 - protein, 435 aa, Homo sapiens
MGPLSAPPCTQHITWKGLLLTASLLNFWNLPTTAQVIIEAKPPKVSEGKDVLLLVHNLPQNLTGYIWYKGQMTDLYHYITSYVVHGQIIYGPAYSGRETVYSNASLLIQNVTQEDAGSYTLHIIKRGDGTGGVTGYFTVTLYSETPKPSISSSNLNPREVMEAVRLICDPETPDASYLWLLNGQNLPMTHRLQLSKTNRTLYLFGVTKYIAGPYECEIRNPVSASRSDPVTLNLLPKLPMPYITINNLNPREKKDVLAFTCEPKSRNYTYIWWLNGQSLPVSPRVKRPIENRILILPSVTRNETGPYQCEIRDRYGGIRSNPVTLNVLYGPDLPRIYPSFTYYRSGENLDLSCFADSNPPAEYSWTINGKFQLSGQKLFIPQITTNHSGLYACSVRNSATGKEISKSMIVKVSETASPQVTYAGPNTWFQEILLL

SEQ ID NO: 58964 - protein, 201 aa, Homo sapiens
MGGDENRGVTGHFTFTLYLETPKPSISSSKLNPREAMEAVSLTCDPETPDASYLWWMNGQSLPMSHRLQLSETNRTLFLLGVTKYTAGPYECEIRNPVSASRSDPFTLNLLHGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 58965 - protein, 426 aa, Homo sapiens
MGLLSAPPCTQRITWKGLLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYLETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSGKRIPVSLAIGI

SEQ ID NO: 58966 - protein, 238 aa, Homo sapiens
MSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSAYSSSINYTAVY

SEQ ID NO: 58967 - protein, 419 aa, Homo sapiens
MGLLSAPPCTQRITWKGLLLTASLLNFWNPPTTAQVTIEAQPTKVSEGKDVLLLVHNLPQNLTGYIWYKGQIRDLYHYITSYVVDGQIIIYGPAYSGRETIYSNASLLIQNVTQEDAGSYTLHIIMGGDENRGVTGHFTFTLYLETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 58968 - protein, 297 aa, Homo sapiens
MGLLSAPPCTQRITWKGLLLTVETPKPSISSSKLNPREAMEAVSLTCDPETPDASYLWWMNGQSLPMSHRLQLSETNRTLFLLGVTKYTAGPYECEIRNPVSASRSDPFTLNLLPKLPKPYITINNLKPRENKDVLNFTCEPKSENYTYIWWLNGQSLPVSPRVKRPIENRILILPSVTRNETGPYQCEIRDQYGGIRSYPVTLNVLYGPDLPRIYPSFTYYRSGEVLYLSCSADSNPPAQYSWTINGKFQLSGQKLFIPQITTKHSGLYACSVRNSATGKESSKSMTVKVSDWTLP

SEQ ID NO: 58969 - protein, 402 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLHGPDLPRIYPSFTYYRSGENLDLSCFTESNPPAEYFWTINGKFQQSGQKLFIPQITRNHSGLYACSVHNSATGKEISKSMTVKVSGKWIPASLAVGFYVESIWLSEKSQENIFIPSLCPMGTSKSQILLLNPPNLSLQTLFSLFFCFLMADLVSGLKKVGRGLYQP

SEQ ID NO: 58970 - protein, 426 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 58971 - protein, 240 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 58972 - protein, 387 aa, Homo sapiens
MGPLPAPSCTQRITWKGLLLTASLLNFWYKGEMTDLYHYIISYIVDGKIIIYGPAYSGRETVYSNASLLIQNVTRKDAGTYTLHIIKRGDETREEIRHFTFTLYLETPKPYISSSNLNPREAMEAVRLICDPETLDASYLWWMNGQSLPVTHRLQLSKTNRTLYLFGVTKYIAGPYECEIRNPVSASRSDPVTLNLLPKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 58973 - protein, 333 aa, Homo sapiens
MGPLPAPSCTQRITWKGLLLTASLLNFWNPPTTAEVTIEAQPPKVSEGKDVLLLVHNLPQNLPGYFWYKGEMTDLYHYIISYIVDGKIIIYGPAYSGRETVYSNASLLIQNVTRKDAGTYTLHIIKRGDETREEIRHFTFTLYSKLPIPYITINNLNPRENKDVLAFTCEPKSENYTYIWWLNGQSLPVSPGVKRPIENRILILPSVTRNETGPYQCEIRDRYGGLRSNPVILNVLYGPDLPRIYPSFTYYRSGENLDLSCFTESNPPAEYFWTINGKFQQSGQKLFIPQITRNHSGLYACSVHNSATGKEISKSMTVKVSGPCHGDLTESQS

SEQ ID NO: 58974 - protein, 343 aa, Homo sapiens
MLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 58975 - protein, 366 aa, Homo sapiens
MLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYAEPVTLSGMAACVPVRASVCLWPPAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 58976 - protein, 360 aa, Homo sapiens
MWRRVCGGLAGRRPSGDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 58977 - protein, 343 aa, Homo sapiens; identical to SEQ ID NO: 58974

SEQ ID NO: 58978 - protein, 366 aa, Homo sapiens; identical to SEQ ID NO: 58975

SEQ ID NO: 58979 - protein, 43 aa, Homo sapiens
MLLLKKHTEDISSVYEIRERLGSGAFSEVVLAQERGSAHLVAL

SEQ ID NO: 58980 - protein, 224 aa, Homo sapiens
MLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQI

SEQ ID NO: 58981 - protein, 43 aa, Homo sapiens; identical to SEQ ID NO: 58979

SEQ ID NO: 58982 - protein, 43 aa, Homo sapiens; identical to SEQ ID NO: 58979

SEQ ID NO: 58983 - protein, 86 aa, Homo sapiens
MLLLKKHTEDISSVYEIRERLGSGAFSEVVLAQERGSAHLVALKCIPKKALRGKEALVENEIAVLRRISHPNIVALEDVHESPSHL

SEQ ID NO: 58984 - protein, 81 aa, Homo sapiens
  MOD_RES (1)..(1): Any amino acid
XISGDTAFDRDILGSVSEQIRKNFARTHWKRAFNATSFLRHIRKLGQIPEGEGASEQGMARHSHSGGPQGLSFLHGCCVLR

SEQ ID NO: 58985 - protein, 226 aa, Homo sapiens
MLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILR

SEQ ID NO: 58986 - protein, 426 aa, Homo sapiens
MEAAFGQVAGSACPRRGGEGRDWKAESLADLWPKSSPGDSHRWCKGPGAGPAGPQLREAARASSGLGGGGRHPSRIPAIALQDMLLLKKHTEDISSVYEIRERLGSGAFSEVVLAQERGSAHLVALKCIPKKALRGKEALVENEIAVLRRISHPNIVALEDVHESPSHLYLAMELVTGGELFDRIMERGSYTEKDASHLVGQVLGAVSYLHSLGIVHRDLKPENLLYATPFEDSKIMVSDFGLSKIQAGNMLGTACGTPGYVAPELLEQKPYGKAVDVWALGVISYILLCGYPPFYDESDPELFSQILRASYEFDSPFWDDISESAKDFIRHLLERDPQKRFTCQQALRHLWISGDTAFDRDILGSVSEQIRKNFARTHWKRAFNATSFLRHIRKLGQIPEGEGASEQGMARHSHSGLRAGQPPKW

SEQ ID NO: 58987 - protein, 43 aa, Homo sapiens; identical to SEQ ID NO: 58979

SEQ ID NO: 58988 - protein, 1627 aa, Homo sapiens
MRLWSWVLHLGLLSAALGCGLAERPRRARRDPRAGRPPRPAAGPATCATRAARGRRASPPPPPPPGGAWEAVRVPRRRQQREARGATEEPSPPSRALYFSGRGEQLRLRADLELPRDAFTLQVWLRAEGGQRSPAVITGLYDKCSYISRDRGWVVGIHTISDQDNKDPRYFFSLKTDRARQVTTINAHRSYLPGQWVYLAATYDGQFMKLYVNGAQVATSGEQVGGIFSPLTQKCKVLMLGGSALNHNYRGYIEHFSLWKVARTQREILSDMETHGAHTALPQLLLQENWDNVKHAWSPMKDGSSPKVEFSNAHGFLLDTSLEPPLCGQTLCDNTEVIASYNQLSSFRQPKVVRYRVVNLYEDDHKNPTVTREQVDFQHHQLAEAFKQYNISWELDVLEVSNSSLRRRLILANCDISKIGDENCDPECNHTLTGHDGGDCRHLRHPAFVKKQHNGVCDMDCNYERFNFDGGECCDPEITNVTQTCFDPDSPHRAYLDVNELKNILKLDGSTHLNIFFAKSSEEELAGVATWPWDKEALMHLGGIVLNPSFYGMPGHTHTMIHEIGHSLGLYHVFRGISEIQSCSDPCMETEPSFETGDLCNDTNPAPKHKSCGDPGPGNDTCGFHSFFNTPYNNFMSYADDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISQHAWYPCTISYPYSQLAQTTFWLRAYFSQPMVAAAVIVHLVTDGTYYGDQKQETISVQLLDTKDQSHDLGLHVLSCRNNPLIIPVVHDLSQPFYHSQAVRVSFSSPLVAISGVALRSFDNFDPVTLSSCQRGETYSPAEQSCVHFACEKTDCPELAVENASLNCSSSDRYHGAQCTVSCRTGYVLQIRRDDELIKSQTGPSVTVTCTEGKWNKQVACEPVDCSIPDHHQVYAASFSCPEGTTFGSQCSFQCRHPAQLKGNNSLLTCMEDGLWSFPEALCELMCLAPPPVPNADLQTARCRENKHKVGSFCKYKCKPGYHVPGSSRKSKKRAFKTQCTQDGSWQEGACVPVTCDPPPPKFHGLYQCTNGFQFNSECRIKCEDSDASQGLGSNVIHCRKDGTWNGSFHVCQEMQGQCSVPNELNSNLKLQCPDGYAIGSECATSCLDHNSESIILPMNVTVRDIPHWLNPTRVERVVCTAGLKWYPHPALIHCVKGCEPFMGDNYCDAINNRAFCNYDGGDCCTSTVKTKKVTPFPMSCDLQGDCACRDPQAQEHSRKDLRGYSHG

SEQ ID NO: 58989 - protein, 566 aa, Homo sapiens
MDCNYERFNFDGGECCDPEITNVTQTCFDPDSPHRAYLDVNELKNILKLDGSTHLNIFFAKSSEEELAGVATWPWDKEALMHLDDDCTDSFTPNQVARMHCYLDLVYQGWQPSRKPAPVALAPQVLGHTTDSVTLEWFPPIDGHFFERELGSACHLCLEGRILVQYASNASSPMPCSPSGHWSPREAEGHPDVEQPCKSSVRTWSPNSAVNPHTVPPACPEPQGCYLELEFLYPLVPESLTIWVTFVSTDWDSSGAVNDIKLLAVSGKNISLGPQNVFCDVPLTIRLWDVGEEVYGIQIYTLDEHLEIDAAMLTSTADTPLCLQCKPLKYKVVRDPPLQMDVASILHLNRKFVDMDLNLGSVYQYWVITISGTEESEPSPAVTYIHGSGYCGDGIIQKDQGEQCDDMNKINGDGCSLFCRQEVSFNCIDEPSRCYFHDGDGVCEEFEQKTSIKDCGVYTPQGFLDQWASNASVSHQDQQCPGWVIIGQPAASQVCRTKVIDLSEGISACLVPLHHQLPIFPAGSDHFLAPGVFFSTNGCRSCHCPPGDGWDILWGPKAGDHQRAAA

SEQ ID NO: 58990 - protein, 665 aa, Homo sapiens [sequence omitted]

SEQ ID NO: 58991 - protein, 1482 aa, Homo sapiens
MRKDRLLHLCLVLLLILLSASDSNSTEPQYMVLVPSLLHTEAPKKGCVLLSHLNETVTVSASLESGRENRSLFTDLVAEKDLFHCVSFTLPRISASSEVAFLSIQIKGPTQDFRKRNTVLVLNTQSLVFVQTDKPMYKPGQTVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRVSVQLKASPAFLASQNTKGEESYCICGNERQTLSWTVTPKTLGNVNFSVSAEAMQSLELCGNEVVEVPEIKRKDTVIKTLLVEAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 58992 - protein, 1268 aa, Homo sapiens
MSESYRRTTFPVRFRVVSVDENFRPRNELIPLIYLENPRRNRIAQWQSLKLEAGINQLSFPLSSEPIQGSYRVVVQTESGGRIQHPFTVEEFVLPKFEVKVQVPKIISIMDEKVNITVCGEYTYGKPVPGLATVSLCRKLSRVLNCDKQEVCEEFSQQLNSNGCITQQVHTKMLQITNTGFEMKLRVEARIREEGTDLEVTANRISEITNIVSKLKFVKVDSHFRQGIPFFAQVLLVDGKGVPIPNKLFFISVNDANYYSNATTNEQGLAQFSINTTSISVNKLFVRVFTVHPNLCFHYSWVAEDHQGAQHTANRVFSLSGSYIHLEPVAGTLPCGHTETITAHYTLNRQAMGELSELSFHYLIMAKGVIVRSGTHTLPVESGDMKGSFALSFPVESDVAPIARMFIFAILPDGEVVGDSEKFEIENCLANKVDLSFSPAQSPPASHAHLQVAAAPQSLCALRAVDQSVLLMKPEAELSVSSVYNLLTVKDLTNFPDNVDQQEEEQGHCPRPFFIHNGAIYVPLSSNEADIYSFLKGMGLKVFTNSKIRKPKSCSVIPSVSAGAVGQGYYGAGLGVVERPYVPQLGTYNVIPLNNEQSSGPVPETVRSYFPETWIWELVAVNSSGVAEVGVTVPDTITEWKAGAFCLSEDAGLGISSTASLRAFQPFFVELTMPYSVIRGEVFTLKATVLNYLPKCIRAEGIEQEKTFSSMTCASGANVSEQLSLKLPSNVVKESARASFSVLGDILGSAMQNIQNLLQMPYGCGEQNMVLFAPNIYVLNYLNETQQLTQEIKAKAVGYLITGYQRQLNYKHQDGSYSTFGERYGRNQGNTWLTAFVLKTFAQARSYIFIDEAHITQSLTWLSQMQKDNGCFRSSGSLLNNAIKGGVEDEATLSAYVTIALLEIPLPVTNPIVRNALFCLESAWNVAKEGTHGSHVYTKALLAYAFSLLGKQNQNREILNSLDKEAVKEDNLVHWERPQRPKAPVGHLYQTQAPSAEVEMTSYVLLAYLTAQPAPTSGDLTSATNIVKWIMKQQNAQGGFSSTQDTVVALHALSRYGAATFTRTEKTAQVTVQDSQTFSTNFQVDNNNLLLLQQISLPELPGEYVITVTGERCVYLQTSMKYNILPEKEDSPFALKVQTVPQTCDGHKAHTSFQISLTISYTGNRPASNMVIVDVKMVSGFIPLKPTVKMLERSSSVSRTEVSNNHVLIYVEQVTNQTLSFSFMVLQDIPVGDLKPAIVKVYDYYETDESVVAEYIAPCSTDTEHGNV

SEQ ID NO: 58993 - protein, 219 aa, Homo sapiens
MVKYFLGQSVLRSSWDQVFAAFWQRYPNPYSKHVLTEDIVHREVTPDQKLLSRRLLTKTNRMPRWAERLFPANVAHSVYVLEDSIVDPQNQTMTTFTWNINHARLMVVEERCVYCVNSDNSGWTEIRREAWVSSSLFGVSRAVQEFGLARFKSNVTKTMKGFEYILAKLQGEAPSKTLVETAKEAKEKAKETALAATEKAKDLASKAATKKQQQQQQFV

SEQ ID NO: 58994 - protein, 589 aa, Homo sapiens
MSSSYWSETSSSSCGTQQLPEVLQCQPQHYHCYHQSSQAQQPPEKNVVYERVRTYSGPMNKVVQALDPFNSREVLSPLKTTSSYQNLVWSDHSQELHSPTLKISTCAPSTLHITQNTEQELHSPTVKLTTYPQTTIRKYVVQNPEQEPLSQFLRGSHFFPGNNVIYEKTIRKVEKLNTDQGCHPQAQCHHHIIQQPQVIHSAHWQQPDSSQQIQAITGNNPISTHIGNELCHSGSSQICEQVIIQDDGPEKLDPRYFGELLADLSRKNTDLYHCLLEHLQRIGGSKQDFESTDESEDIESLIPKGLSEFTKQQIRYILQMRGMSDKSLRLVLSTFSNIREELGHLQNDMTSLENDKMRLEKDLSFKDTQLKEYEELLASVRANNHQQQQGLQDSSSKCQALEENNLSLRHTLSDMEYRLKELEYCKRNLEQENQNLRMQVSETCTGPMLQAKMDEIGNHYTEMVKNLRMEKDREICRLRSQLNQYHKDVSKREGSCSDFQFKLHELTSLLEEKDSLIKRQSEELSKLRQEIYSSHNQPSTGGRTTITTKKYRTQYPILGLLYDDYEYIPPGSETQTIVIEKTEDKYTCP

SEQ ID NO: 58995 - protein, 306 aa, Homo sapiens
MSSSYWSETSSSSCGTQQLPEVLQCQPQHYHCYHQSSQAQQPPEKNVVYERVRTYSGPMNKVVQALDPFNSREVLSPLKTTSSYQNLVWSDHSQELHSPTLKISTCAPSTLHITQNTEQELHSPTVKLTTYPQTTIRKYVVQNPEQEPLSQFLRGSHFFPGNNVIYEKTIRKVEKLNTDQGCHPQAQCHHHIIQQPQVIHSAHWQQPDSSQQIQAITGNNPISTHIGNELCHSGSSQICEQVIIQDDGPEKLDPRYFGELLADLSRKNTDLYHCLLEHLQRIGRKQSLSSTYTIRHGIQTKRTGIL

SEQ ID NO: 58996 - protein, 595 aa, Homo sapiens
MSSSYWSETSSSSCGTQQLPEVLQCQPQHYHCYHQSSQAQQPPEKNVVYERVRTYSGPMNKVVQALDPFNSREVLSPLKTTSSYQNLVWSDHSQELHSPTLKISTCAPSTLHITQNTEQELHSPTVKLTTYPQTTIRKYVVQNPEQEPLSQFLRGSHFFPGNNVIYEKTIRKVEKLNTDQGCHPQAQCHHHIIQQPQVIHSAHWQQPDSSQQIQAITGNNPISTHIGNELCHSGSSQICEQVIIQDDGPEKLDPRYFGELLADLSRKNTDLYHCLLEHLQRIGGSKQDFESTDESEDIESLIPKGLSEFTKQQIRYILQMRGMSDKSLRLVLSTFSNIREELGHLQNDMTSLENDKMRLEKDLSFKDTQLKEYEELLASVRANNHQQQQGLQDSSSKCQALEENNLSLRHTLSDMEYRLKELEYCKRNLEQENQNLRMQVSETCTGPMLQAKMDEIGNHYTEMVKNLRMEKDREICRLRSQLNQYHKDVSKREGSCSDFQFKLHELTSLLEEKDSLIKRQSEELSKLRQEIYSSHNQPSTGGRTTITTKKYRTQYPILGLLYDDYEYIPPGSETQTIVIEKTEDKYTCVSSLGHF

SEQ ID NO: 58997 - protein, 306 aa, Homo sapiens
MASRWWRWRRGCSWKPAARSPGPGSPGRAGPLGPSAAAEVRAQVHRRKGLDLSQIPYINLVKHLTSACPNVCRISRFHHTTPDSKTHSGEKYTDPFKLGWRDLKGLYEDIRKELLISTSELKEMSEYYFDGKGKAFRPIIVALMARACNIHHNNSRHVQASQRAIALIAEMIHTASLVHDDVIDDASSRRGKHTVNKIWGEKKAVLAGDLILSAASIALARIGNTTVISILTQVIEDLVRGEFLQLGSKENENERFAHYLEKTFKKTASLIANSCKAVFPRNECYDHATVQFAWRCRQSSTVCTTE

SEQ ID NO: 58998 - protein, 415 aa, Homo sapiens
MASRWWRWRRGCSWKPAARSPGPGSPGRAGPLGPSAAAEVRAQVHRRKGLDLSQIPYINLVKHLTSACPNVCRISRFHHTTPDSKTHSGEKYTDPFKLGWRDLKGLYEDIRKELLISTSELKEMSEYYFDGKGKAFRPIIVALMARACNIHHNNSRHVQASQRAIALIAEMIHTASLVHDDVIDDASSRRGKHTVNKIWGEKKAVLAGDLILSAASIALARIGNTTVISILTQVIEDLVRGEFLQLGSKENENERFAHYLEKTFKKTASLIANSCKAVSVLGCPDPVVHEIAYQYGKNVGIAFQLIDDVLDFTSCSDQMGKPTSADLKLGLATGPVLFACQQFPEMNAMIMRRFSLPGDVDRARQYVLQSDGVQQTTYLAQQYCHEAIREISKLRPSPERDALIQLSEIVLTRDK

SEQ ID NO: 58999 - protein, 376 aa, Homo sapiens
MPAHVHRRKGLDLSQIPYINLVKHLTSACPNVCRISRFHHTTPDSKTHSGEKYTDPFKLGWRDLKGLYEDIRKELLISTSELKEMSEYYFDGKGKAFRPIIVALMARACNIHHNNSRHVQASQRAIALIAEMIHTASLVHDDVIDDASSRRGKHTVNKIWGEKKAVLAGDLILSAASIALARIGNTTVISILTQVIEDLVRGEFLQLGSKENENERFAHYLEKTFKKTASLIANSCKAVSVLGCPDPVVHEIAYQYGKNVGIAFQLIDDVLDFTSCSDQMGKPTSADLKLGLATGPVLFACQQFPEMNAMIMRRFSLPGDVDRARQYVLQSDGVQQTTYLAQQYCHEAIREISKLRPSPERDALIQLSEIVLTRDK

SEQ ID NO: 59000 - protein, 240 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKSFSFNGPIAIYQMGDCESAWILSKHPRALS

SEQ ID NO: 59001 - protein, 89 aa, Homo sapiens
MELAKHDAEVQNMAFQYGKHMAMSHKINSDVQPFIKEKTSDSMTFNLNSAPVVLHQEFLGRDLWIKQIGESSSTEVQLSNFQQMLLSTL

SEQ ID NO: 59002 - protein, 399 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKESYITDDIGISTWKEQTFLSHGALLAKSCQAAMELAKHDAEVQNMAFQYGKHMAMSHKINSDVQPFIKEKTSDSMTFNLNSAPVVLHQEFLGRDLWIKQIGEAQEKGRLDYAKLRERIKAGKGVTSAIDLCRYHGNKALEALESFPPSEARSALENIVFAVTRFS

SEQ ID NO: 59003 - protein, 80 aa, Homo sapiens
VQNMAFQYGKHMAMSHKINSDVQPFIKEKTSDSMTFNLNSAPVVLHQEFLGRDLWIKQIGESSSTEVQLSNFQQMLLSTL

SEQ ID NO: 59004 - protein, 297 aa, Homo sapiens
MNFRQLLLHLPRYLGASGSPRRLWWSPSLDTISSVGSWRGRSSKSPAHWNQVVSEAEKIVGYPTSFMSLRCLLSDELSNIAMQVRKLVGTQHPLLTTARGLVHDSWNSLQLRGLVVLLISKAAGPSSVNTSCQNYDMVSGIYSCQRSLAEITELIHIALLVHRGIVNLNELQSSDGPLKDMQFGNKIAILSGDFLLANACNGLALLQNTKVVELLASALMDLVQGVYHENSTSKAQEKGRLDYAKLRERIKAGKGVTSAIDLCRYHGNKALEALESFPPSEARSALENIVFAVTRFS

SEQ ID NO: 59005 - protein, 293 aa, Homo sapiens
MGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTVLGLCPL

SEQ ID NO: 59006 - protein, 505 aa, Homo sapiens
MGRVVAELVSSLLGLWLLLCSCGCPEGAELRAPPDKIAIIGAGIGGTSAAYYLRQKFGKDVKIDLFEREEVGGRLATMMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIILHDRLYYLNGIECAASAMEMSAIAAHNAALLAYHRWNGHTDMIDQDGLYEKLKTEL

SEQ ID NO: 59007 - protein, 428 aa, Homo sapiens
MMVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIILHDRLYYLNGIECAASAMEMSAIAAHNAALLAYHRWNGHTDMIDQDGLYEKLKTEL

SEQ ID NO: 59008 - protein, 427 aa, Homo sapiens
MVQGQEYEAGGSVIHPLNLHMKRFVKDLGLSAVQASGGLLGIYNGETLVFEESNWFIINVIKLVWRYGFQSLRMHMWVEDVLDKFMRIYRYQSHDYAFSSVEKLLHALGGDDFLGMLNRTLLETLQKAGFSEKFLNEMIAPVMRVNYGQSTDINAFVGAVSLSCSDSGLWAVEGGNKLVCSGLLQASKSNLISGSVMYIEEKTKTKYTGNPTKMYEVVYQIGTETRSDFYDIVLVATPLNRKMSNITFLNFDPPIEEFHQYYQHIVTTLVKGELNTSIFSSRPIDKFGLNTVLTTDNSDLFINSIGIVPSVREKEDPEPSTDGTYVWKIFSQETLTKAQILKLFLSYDYAVKKPWLAYPHYKPPEKCPSIILHDRLYYLNGIECAASAMEMSAIAAHNAALLAYHRWNGHTDMIDQDGLYEKLKTEL

SEQ ID NO: 59009 - protein, 494 aa, Homo sapiens
MARAAPLLAALTALLAAAAAGGDAPPGKIAVVGAGIGGSAVAHFLQQHFGPRVQIDVYEKGTVGGRLATISVNKQHYESGAASFHSLSLHMQDFVKLLGLRHRREVVGRSAIFGGEHFMLEETDWYLLNLFRLWWHYGISFLRLQMWVEEVMEKFMRIYKYQAHGYAFSGVEELLYSLGESTFVNMTQHSVAESLLQVGVTQRFIDDVVSAVLRASYGQSAAMPAFAGAMSLAGAQGSLWSVEGGNKLVCSGLLKLTKANVIHATVTSVTLHSTEGKALYQVAYENEVGNSSDFYDIVVIATPLHLDNSSSNLTFAGFHPPIDDVQGSFQPTVVSLVHGYLNSSYFGFPDPKLFPFANILTTDFPSFFCTLDNICPVNISASFRRKQPQEAAVWRVQSPKPLFRTQLKTLFRSYYSVQTAEWQAHPLYGSRPTLPRFALHDQLFYLNALEWAASSVEVMAVAAKNVALLAYNRWYQDLDKIDQKDLMHKVKTEL

SEQ ID NO: 59010 - protein, 176 aa, Homo sapiens
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMRQYLVLSMQSSQRRRTLHQNGNV

SEQ ID NO: 59011 - protein, 154 aa, Homo sapiens
MKVLLCDLLLLSLFSSVFSSCQRDCLTCQEKLHPALDSFDLEVCILECEEKVFPSPLWTPCTKVMARSSWQLSPAAPEHVAAALYQPRASEMQHLRRMPRVRSLFQEQEEPEPGMEEAGEMEQKQLQKRFGGFTGARKSARKLANQKRFSEFMR

SEQ ID NO: 59012 - protein, 409 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 59013 - protein, 467 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 59014 - protein, 378 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAERACLPPAAINLLSIAPMAPRLFMPKGACRPTAQKGSHKTLLQRMMMAGSVRNGKPRGTVI

SEQ ID NO: 59015 - protein, 463 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVIHAWLIISSLLLLFFFSFIYLGEVFKTYNVAVDYITVALLIWNFGVVGMISIHWKGPLRLQQAYLIMISALMALVFIKYLPEWTAWLILAVISVYDLVAVLCPKGPLRMLVETAQERNETLFPALIYSSTMVWLVNMAEGDPEAQRRVSKNSKYNAESTERESQDTVAENDDGGFSEEWEAQRDSHLGPHRSTPESRAAVQELSSSILAGEDPEERGVKLGLGDFIFYSVLVGKASATASGDWNTTIACFVAILIGLCLTLLLLAIFKKALPALPISITFGLVFYFATDYLVQPFMDQLAFHQFYI

SEQ ID NO: 59016 - protein, 184 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYKYRCYKVSMRHRSLLSTLFFLWLGILVTVT

SEQ ID NO: 59017 - protein, 463 aa, Homo sapiens; identical to SEQ ID NO: 59015

SEQ ID NO: 59018 - protein, 92 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVV

SEQ ID NO: 59019 - protein, 147 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLV

SEQ ID NO: 59020 - protein, 109 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRK

SEQ ID NO: 59021 - protein, 155 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIMISVIVVMTILLVVLYK

SEQ ID NO: 59022 - protein, 58 aa, Homo sapiens
MTELPAPLSYFQNAQMSEDNHLSNTNDNRERQEHNDRRSLGHPEPLSNGRPQGNSRQV

SEQ ID NO: 59023 - protein, 92 aa, Homo sapiens; identical to SEQ ID NO: 59018

SEQ ID NO: 59024 - protein, 63 aa, Homo sapiens
MTELPAPLSYFQNAQMSEDNHLSNTNDNRERQEHNDRRSLGHPEPLSNGRPQGNSRQVVEQDE

SEQ ID NO: 59025 - protein, 91 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVV

SEQ ID NO: 59026 - protein, 62 aa, Homo sapiens
MTELPAPLSYFQNAQMSEDNHLSNTNDNRERQEHNDRRSLGHPEPLSNGRPQGNSRQVVEQD

SEQ ID NO: 59027 - protein, 99 aa, Homo sapiens
MTELPAPLSYFQNAQMSEDNHLSNTVRSQNDNRERQEHNDRRSLGHPEPLSNGRPQGNSRQVVEQDEEEDEELTLKYGAKHVIMLFVPVTLCMVVVVAT

SEQ ID NO: 59028 - protein, 135 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQLIYTPFTEDTETVGQRALHSILNAAIM

SEQ ID NO: 59029 - protein, 109 aa, Homo sapiens
MTELPAPLSYFQNAQMSEDNHLSNTNDNRERQEHNDRRSLGHPEPLSNGRPQGNSRQVVEQDEEEDEELTLKYGAKHVIMLFVPVTLCMVVVVATIKSVSFYTRKDGQL

SEQ ID NO: 59030 - protein, 415 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYAAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 59031 - protein, 481 aa, Homo sapiens
MLAGTVRFARHCLKFFPAQKPACVDFGASRGRAMLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 59032 - protein, 448 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 59033 - protein, 481 aa, Homo sapiens; identical to SEQ ID NO: 59031

SEQ ID NO: 59034 - protein, 447 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTPSVGQRLLNSVLNTLIMISVIVVMTIFLVVLYKYRCYKFIHGWLIMSSLMLLFLFTYIYLGEVLKTYNVAMDYPTLLLTVWNFGAVGMVCIHWKGPLVLQQAYLIMISALMALVFIKYLPEWSAWVILGAISVYDLVAVLCPKGPLRMLVETAQERNEPIFPALIYSSAMVWTVGMAKLDPSSQGALQLPYDPEMEDSYDSFGEPSYPEVFEPPLTGYPGEELEEEEERGVKLGLGDFIFYSVLVGKAAATGSGDWNTTLACFVAILIGLCLTLLLLAVFKKALPALPISITFGLIFYFSTDNLVRPFMDTLASHQLYI

SEQ ID NO: 59035 - protein, 129 aa, Homo sapiens
MLTFMASDSEEEVCDERTSLMSAESPTPRSCQEGRQGPEDGENTAQWRSQENEEDGEEDPDRYVCSGVPGRPPGLEEELTLKYGAKHVIMLFVPVTLCMIVVVATIKSVRFYTEKNGQLIYTPFTEDTP

SEQ ID NO: 59036 - protein, 21 aa, Homo sapiens
MLTFMASDSEEEVCDERTSLM

SEQ ID NO: 59037 - protein, 329 aa, Homo sapiens
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASSVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 59038 - protein, 379 aa, Homo sapiens
MAWRGWAQRGWGCGQAWGASVGGRSCEELTAVLTPPQLLGRRFNFFIQQKCGFRKAPRKVEPRRSDPGTSGEAYKRSALIPPVEETVFYPSPYPIRSLIKPLFFTVGFTGCAFGSAAIWQYESLKSRVQSYFDGIKADWLDSIRPQKEGDFRKEINKWWNNLSDGQRTVTGIIAANVLVFCLWRVPSLQRTMIRYFTSNPASKVLCSPMLLSTFSHFSLFHMAANMYVLWSFSSSIVNILGQEQFMAVYLSAGVISNFVSYVGKVATGRYGPSLGASGAIMTVLAAVCTKIPEGRLAIIFLPMFTFTAGNALKAIIAMDTAGMILGWKFFDHAAHLGGALFGIWYVTYGHELIWKNREPLVKIWHEIRTNGPKKGGGSK

SEQ ID NO: 59039 - protein, 101 aa, Homo sapiens
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 59040 - protein, 101 aa, Homo sapiens; identical to SEQ ID NO: 59039

SEQ ID NO: 59041 - protein, 125 aa, Homo sapiens
MAKYLAQIIVMGVQVVGRAFARALRQEFAASRAAADARGRAGHRSAAASNLSGLSLQEAQQILNVSKLSPEEVQKNYEHLFKVNDKSVGGSFYLQSKVVRAKERLDEELKIQAQEDREKGQMPHT

SEQ ID NO: 59042 - protein, 831 aa, Homo sapiens
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCFTCNELLVDLIYFYQDGKIHCGRHHAELLKPRCSACDEIIFADECTEAEGRHWHMKHFCCLECETVLGGQRYIMKDGRPFCCGCFESLYAEYCETCGEHIGVDHAQMTYDGQHWHATEACFSCAQCKASLLGCPFLPKQGQIYCSKTCSLGEDVHASDSSDSAFQSARSRDSRRSVRMGKSSRSADQCRQSLLLSPALNYKFPGLSGNADDTLSRKLDDLSLSRQGTSFASEEFWKGRVEQETPEDPEEWADHEDYMTQLLLKFGDKSLFQPQPNEMDIRASEHWISDNMVKSKTELKQNNQSLASKKYQSDMYWAQSQDGLGDSAYGSHPGPASSRRLQELELDHGASGYNHDETQWYEDSLECLSDLKPEQSVRDSMDSLALSNITGASVDGENKPRPSLYSLQNFEEMETEDCEKMSNMGTLNSSMLHRSAESLKSLSSELCPEKILPEEKPVHLPVLRRSKSQSRPQQVKFSDDVIDNGNYDIEIRQPPMSERTRRRVYNFEERGSRSHHHRRRRSRKSRSDNALNLVTERKYSPKDRLRLYTPDNYEKFIQNKSAREIQAYIQNADLYGQYAHATSDYGLQNPGMNRFLGLYGEDDDSWCSSSSSSSDSEEEGYFLGQPIPQPRPQRFAYYTDDLSSPPSALPTPQFGQRTTKSKKKKGHKGKNCIIS

SEQ ID NO: 59043 - protein, 831 aa, Homo sapiens; identical to SEQ ID NO: 59042

SEQ ID NO: 59044 - protein, 831 aa, Homo sapiens; identical to SEQ ID NO: 59042

SEQ ID NO: 59045 - protein, 110 aa, Homo sapiens
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALG

SEQ ID NO: 59046 - protein, 831 aa, Homo sapiens; identical to SEQ ID NO: 59042

SEQ ID NO: 59047 - protein, 119 aa, Homo sapiens
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSR

SEQ ID NO: 59048 - protein, 159 aa, Homo sapiens
MPLEMEPKMSKLAFGCQRSSTSDDDSGCALEEYAWVPPGLRPEQIQLYFACLPEEKVPYVNSPGEKHRIKQLLYQLPPHDNEVRYCQSLSEEEKKELQVFSAQRKKEALGRGTIKLLSRAVMHAVCEQCGLKINGGEVAVFASRAGPGVCWHPSCFVCF

SEQ ID NO: 59049 - protein, 831 aa, Homo sapiens; identical to SEQ ID NO: 59042

SEQ ID NO: 59050 - protein, 844 aa, Homo sapiens
MVTVMPLEMEKTISKLMFDFQRNSTSDDDSGCALEEYAWVPPGLKPEQVHQYYSCLPEEKVPYVNSPGEKLRIKQLLHQLPPHDNEVRYCNSLDEEEKRELKLFSSQRKRENLGRGNVRPFPVTMTGAICEQCGGQINGGDIAVFASRAGHGVCWHPPCFVCTVCNELLVDLIYFYQDGKIYCGRHHAECLKPRCAACDEIIFADECTEAEGRHWHMKHFCCFECETVLGGQRYIMKEGRPYCCHCFESLYAEYCDTCAQHIGIDQGQMTYDGQHWHATETCFCCAHCKKSLLGRPFLPKQGQIFCSRACSAGEDPNGSDSSDSAFQNARAKESRRSAKIGKNKGKTEEPMLNQHSQLQVSSNRLSADVDPLSLQMDMLSLSSQTPSLNRDPIWRSREEPYHYGNKMEQNQTQSPLQLLSQCNIRTSYSPGGQGAGAQPEMWGKHFSNPKRSSSLAMTGHAGSFIKECREDYYPGRLRSQESYSDMSSQSFSETRGSIQVPKYEEEEEEEGGLSTQQCRTRHPISSLKYTEDMTPTEQTPRGSMESLALSNATGLSADGGAKRQEHLSRFSMPDLSKDSGMNVSEKLSNMGTLNSSMQFRSAESVRSLLSAQQYQEMEGNLHQLSNPIGYRDLQSHGRMHQSFDFDGGMAGSKLPGQEGVRIQPMSERTRRRATSRDDNRRFRPHRSRRSRRSRSDNALHLASEREAISRLKDRPPLRAREDYDQFMRQRSFQESMGHGSRRDLYGQCPRTVSDLALQNAFGDRWGPYFAEYDWCSTCSSSSESDNEGYFLGEPIPQPARLRYVTSDELLHKYSSYGLPKSSTLGGRGQLHSRKRQKSKNCIIS

SEQ ID NO: 59051 - protein, 150 aa, Homo sapiens
MVTVMPLEMEKTISKLMFDFQRNSTSDDDSGCALEEYAWVPPGLKPEQVHQYYSCLPEEKVPYVNSPGEKLRIKQLLHQLPPHDNEVRYCNSLDEEEKRELKLFSSQRKRENLGRGNVRPFPVTMTGAICEQCGGQINGGDIAVFASRAG

SEQ ID NO: 59052 - protein, 420 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKEDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALVPETIHDELQQSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 59053 - protein, 427 aa, Homo sapiens
METFDPTELPELLKLYYRRLFPYSQYYRWLNYGGVIKNYFQHREFSFTLKDDIYIRYQSFNNQSDLEKEMQKMNPYKIDIGAVYSHRPNQHNTVKLGAFQAQEKELVFDIDMTDYDDVRRCCSSADICPKCWTLMTMAIRIIDRALKGKDFGFKHRLWVYSGRRGVHCWVCDESVRKLSSAVRSGIVEYLSLVKGGQDVKKKVHLSEKIHPFIRKSINIIKKYFEEYALVNQDILENKESWDKILALMGLFLNDPSPIHDELQQSFQKSHNSLQRWEHLKKVASRYQNNIKNDKYGPWLEWEIMLQYCFPRLDINVSKGINHLLKSPFSVHPKTGRISVPIDLQKVDQFDPFTVPTISFICRELDAISTNEEEKEENEAESDVKHRTRDYKKTSLAPYVKVFEHFLENLDKSRKGELLKKSDLQKDF

SEQ ID NO: 59054 - protein, 253 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 59055 - protein, 249 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIF

SEQ ID NO: 59056 - protein, 253 aa, Homo sapiens; identical to SEQ ID NO: 59054

SEQ ID NO: 59057 - protein, 192 aa, Homo sapiens
MEHWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQYERESQAYYQRGSSMVLFSSPPVILLISFLIFLIVG

SEQ ID NO: 59058 - protein, 217 aa, Homo sapiens
MANLGCWMLVLFVATWSDLGLCKKRPKPGGWNTGGSRYPGQGSPGGNRYPPQGGGGWGQPHGGGWGQPHGGGWGQPHGGGWGQPHGGGWGQGGGTHSQWNKPSKPKTNMKHMAGAAAAGAVVGGLGGYMLGSAMSRPIIHFGSDYEDRYYRENMHRYPNQVYYRPMDEYSNQNNFVHDCVNITIKQHTVTTTTKGENFTETDVKMMERVVEQMCITQ

SEQ ID NO: 59059 - protein, 176 aa, Homo sapiens
MRKHLSWWWLATVCMLLFSHLSAVQTRGIKHRIKWNRKALPSTAQITEAQVAENRPGAFIKQGRKLDIDFGAEGNRYYEANYWQFPDGIHYNGCSEANVTKEAFVTGCINATQAANQGEFQKPDNKLHQQVLWRLVQELCSLKHCEFWLERGAGLRVTMHQPVLLCLLALIWLTVK

SEQ ID NO: 59060 - protein, 340 aa, Homo sapiens
MATGGYRTSSGLGGSTTDFLEEWKAKREKMRAKQNPPGPAPPGGGSSDAAGKPPAGALGTPAAAAANELNNNLPGGAPAAPAVPGPGGVNCAVGSAMLTRAAPGPRRSEDEPPAASASAAPPPQRDEEEPDGVPEKGKSSGPSARKGKGQIEKRKLREKRRSTGVVNIPAAECLDEYEDDEAGQKERKREDAITQQNTIQNEAVNLLDPGSSYLLQEPPRTVSGRYKSTTSVSEEDVSSRYSRTDRSGFPRYNRDANVSGTLVSSSTLEKKIEDLEKEVVRERQENLRLVRLMQDKEEMIGKLKEEIDLLNRDLDDIEDENEQLKQENKTLLKVVGQLTR

SEQ ID NO: 59061 - protein, 76 aa, Homo sapiens
MATGGYRTSSGLGGSTTDFLEEWKAKREKMRAKQNPPGPAPPGGGSSDAAGKPPAGALGTPAAAAANELNNNLPGG

SEQ ID NO: 59062 - protein, 64 aa, Homo sapiens
MATGGYRTSSGLGGSTTDFLEEWKAKREKMRAKQNPPGPAPPGGGSSDAAGKPPAGALGTPAAA

SEQ ID NO: 59063 - protein, 220 aa, Homo sapiens
MKSVIYHALSQKEANDSDVQPSGAQRAEAFVRAFLKRSTPRMSPQAREDQLQRKAVVLEYFTRHKRKEKKKKAKGLSARQRRELRLFDIKPEQQRYSLFLPLHELWKQYIRDLCSGLKPDTQPQMIQAKLLKADLHGAIISVTKSKCPSYVGITGILLQETKHIFKIITKEDRLKVIPKLNCVFTVETDGFISYIYGSKFQLRSSERSAKKFKAKGTIDL

SEQ ID NO: 59064 - protein, 220 aa, Homo sapiens; identical to SEQ ID NO: 59063

SEQ ID NO: 59065 - protein, 139 aa, Homo sapiens
MHCLRKRRMTPMSRYSLFLPLHELWKQYIRDLCSGLKPDTQPQMIQAKLLKADLHGAIISVTKSKCPSYVGITGILLQETKHIFKIITKEDRLKVIPKLNCVFTVETDGFISYIYGSKFQLRSSERSAKKFKAKGTIDL

SEQ ID NO: 59066 - protein, 113 aa, Homo sapiens
MVRFKHRYLLCELVSDDPRCRLSLDDRVLSSLVRDTIARVHGTFGAAACSIGFAGTIRTCQKFLIQYNRRQLLILLQNCTDEGEREAIQKSVTRSCLLEEEEESGEEAAEAME

SEQ ID NO: 59067 - protein, 163 aa, Homo sapiens
MVRFKHRYLLCELVSDDPRCRLSLDDRVLSSLVRDTIARVHGTFGAAACSIGFAVRYLNAYTGIVLLRCRKEFYQLVWSALPFITYLENKGHRYPCFFNTLHVGGTIRTCQKFLIQYNRRQLLILLQNCTDEGEREAIQKSVTRSCLLEEEEESGEEAAEAME

SEQ ID NO: 59068 - protein, 140 aa, Homo sapiens
MAENREPRGAVEAELDPVEYTLRKRLPSRLPRRPNDIYVNMKTDFKAQLARCQKLLDGGARGQNACSEIYIHGLGLAINRAINIALQLQAGSFGSLQVAANTSTVELVDELEPETDTREPLTRIRNNSAIHIRVFRVTPK

SEQ ID NO: 59069 - protein, 137 aa, Homo sapiens
MAENREPRGAVEAELDPVEYTLRKRLPSRLPRRPNDIYVNMKTDFKAQLARCQKLLDGGARGQNACSEIYIHGLGLAINRAINIALQLQAGSFGSLQVAANTSTVELVDELEPETDTREPLTRIRNNSAIHIRVFRV

SEQ ID NO: 59070 - protein, 449 aa, Homo sapiens
MLPAATASLLGPLLTACALLPFAQGQTPNYTRPVFLCGGDVKGESGYVASEGFPNLYPPNKECIWTITVPEGQTVSLSFRVFDLELHPACRYDALEVFAGSGTSGQRLGRFCGTFRPAPLVAPGNQVTLRMTTDEGTGGRGFLLWYSGRATSGTEHQFCGGRLEKAQGTLTTPNWPESDYPPGISCSWHIIAPPDQVIALTFEKFDLEPDTYCRYDSVSVFNGAVSDDSRRLGKFCGDAVPGSISSEGNELLVQFVSDLSVTADGFSASYKTLPRGTAKEGQGPGPKRGTEPKVKLPPKSQPPEKTEESPSAPDAPTCPKQCRRTGTLQSNFCASSLVVTATVKSMVREPGEGLAVTVSLIGAYKTGGLDLPSPPTGASLKFYVPCKQCPPMKKGVSYLLMGQVEENRGPVLPPESFVVLHRPNQDQILTNLSKRKCPSQPVRAAASQD

SEQ ID NO: 59071 - protein, 415 aa, Homo sapiens
MRGANAWAPLCLLLAAATQLSRQQSPERPVFTCGGILTGESGFIGSEGFPGVYPPNSKCTWKITVPEGKVVVLNFRFIDLESDNLCRYDFVDVYNGHANGQRIGRFCGTFRPGALVSSGNKMMVQMISDANTAGNGFMAMFSAAEPNERGDQYCGGLLDRPSGSFKTPNWPDRDYPAGVTCVWHIVAPKNQLIELKFEKFDVERDNYCRYDYVAVFNGGEVNDARRIGKYCGDSPPAPIVSERNELLIQFLSDLSLTADGFIGHYIFRPKKLPTTTEQPVTTTFPVTTGLKPTVALCQQKCRRTGTLEGNYCSSDFVLAGTVITTITRDGSLHATVSIINIYKEGNLAIQQAGKNMSARLTVVCKQCPLLRRGLNYIIMGQVGEDGRGKIMPNSFIMMFKTKNQKLLDALKNKQC

SEQ ID NO: 59072 - protein, 727 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 59073 - protein, 199 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKRVSRLHS

SEQ ID NO: 59074 - protein, 774 aa, Homo sapiens
MRPLLLLALLGWLLLAEAKGDAKPEAPCCQEGLRAGGSGSLHLGRDFTVLAGARGSPSPSVSSIPRFWIPGSDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALDEVVLKFEMGHVRARNLAYDTLPVLIHGNGPTKLQLNYLGNYIPRFWTFETGCTVCDEGLRSLKGIGDEALPTVLVGVFIEQPTPFVSLFFQRLLRLHYPQKHMRLFIHNHEQHHKAQVEEFLAQHGSEYQSVKLVGPEVRMANADARNMGADLCRQDRSCTYYFSVDADVALTEPNSLRLLIQQNKNVIAPLMTRHGRLWSNFWGALSADGYYARSEDYVDIVQGRRVGVWNVPYISNIYLIKGSALRGELQSSDLFHHSKLDPDMAFCANIRQQDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 59075 - protein, 391 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLLEDVFMFLTNRHTLGHLLSLDSYRTTHLHNDLWEVFSNPEDWKEKYIHQNYTKALAGKLVETPCPDVYWFPIFTEVACDELVEEMEHFGQWSLGNNKDNRIQGGYENVPTIDIHMNQIGFEREWHKFLLEYIAPMTEKLYPGYYTRAQFDLAFVVRYKPDEQPSLMPHHDASTFTINIALNRVGVDYEGGGCRFLRYNCSIRAPRKGWTLMHPGRLTHYHEGLPTTRGTRYIAVSFVDP

SEQ ID NO: 59076 - protein, 283 aa, Homo sapiens
MRPLLLLALLGWLLLAEAKGDAKPEDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDSDQLFYTKIFLDPEKREQINITLDHRCRIFQNLDGALVSPWGQGHLPGACYELTASVLTSELSVMPSFPAVVLQLNYLGNYIPRFWTFETGCTVCDEGLRSLKGIG

SEQ ID NO: 59077 - protein, 225 aa, Homo sapiens
MRPLLLLALLGWLLLAEAKGDAKPEAPCCQEGLRAGGSGSLHLGRDFTVLAGARGSPSPSVSSIPRFWIPGSDNLLVLTVATKETEGFRRFKRSAQFFNYKIQALGLGEDWNVEKGTSAGGGQKVRLLKKALEKHADKEDLVILFADSYDVLFASGPRELLKKFRQARSQVVFSAEELIYPDRRLETKYPVVSDGKRFLGSGGFIGYAPNLSKLVAEWEGQDSDS

SEQ ID NO: 59078 - protein, 758 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 59079 - protein, 737 aa, Homo sapiens
MGGCTVKPQLLLLALVLHPWNPCLGADSEKPSSIPTDKLLVITVATKESDGFHRFMQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 59080 - protein, 418 aa, Homo sapiens
MLENHILHKRIYILTFFSQQIFILCHAHFIFFFTVRDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 59081 - protein, 703 aa, Homo sapiens
MQSAKYFNYTVKVLGQGEEWRGGDGINSIGGGQKVRLMKEVMEHYADQDDLVVMFTECFDVIFAGGPEEVLKKFQKANHKVVFAADGILWPDKRLADKYPVVHIGKRYLNSGGFIGYAPYVNRIVQQWNLQDNDDDQLFYTKVYIDPLKREAINITLDHKCKIFQTLNGAVDEVVLKFENGKARAKNTFYETLPVAINGNGPTKILLNYFGNYVPNSWTQDNGCTLCEFDTVDLSAVDVHPNVSIGVFIEQPTPFLPRFLDILLTLDYPKEALKLFIHNKEVYHEKDIKVFFDKAKHEIKTIKIVGPEENLSQAEARNMGMDFCRQDEKCDYYFSVDADVVLTNPRTLKILIEQNRKIIAPLVTRHGKLWSNFWGALSPDGYYARSEDYVDIVQGNRVGVWNVPYMANVYLIKGKTLRSEMNERNYFVRDKLDPDMALCRNAREMTLQREKDSPTPETFQMLSPPKGVFMYISNRHEFGRLLSTANYNTSHYNNDLWQIFENPVDWKEKYINRDYSKIFTENIVEQPCPDVFWFPIFSEKACDELVEEMEHYGKWSGGKHHDSRISGGYENVPTDDIHMKQVDLENVWLHFIREFIAPVTLKVFAGYYTKGFALLNFVVKYSPERQRSLRPHHDASTFTINIALNNVGEDFQGGGCKFLRYNCSIESPRKGWSFMHPGRLTHLHEGLPVKNGTRYIAVSFIDP

SEQ ID NO: 59082 - protein, 738 aa, Homo sapiens
MTSSGPGPRFLLLLPLLLPPAASASDRPRGRDPVNPEKLLVITVATAETEGYLRFLRSAEFFNYTVRTLGLGEEWRGGDVARTVGGGQKVRWLKKEMEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGQPPPRVFLAVFVEQPTPFLPRFLQRLLLLDYPPDRVTLFLHNNEVFHEPHIADSWPQLQDHFSAVKLVGPEEALSPGEARDMAMDLCRQDPECEFYFSLDADAVLTNLQTLRILIEENRKVIAPMLSRHGKLWSNFWGALSPDEYYARSEDYVELVQRKRVGVWNVPYISQAYVIRGDTLRMELPQRDVFSGSDTDPDMAFCKSFRDKGIFLHLSNQHEFGRLLATSRYDTEHLHPDLWQIFDNPVDWKEQYIHENYSRALEGEGIVEQPCPDVYWFPLLSEQMCDELVAEMEHYGQWSGGRHEDSRLAGGYENVPTVDIHMKQVGYEDQWLQLLRTYVGPMTESLFPGYHTKARAVMNFVVRYRPDEQPSLRPHHDSSTFTLNVALNHKGLDYEGGGCRFLRYDCVISSPRKGWALLHPGRLTHYHEGLPTTWGTRYIMVSFVDP

SEQ ID NO: 59083 - protein, 76 aa, Homo sapiens
MTSSGPGPRFLLLLPLLLPPAASASDRPRGRDPVNPEKLLVITVATAETEGYLRFLRSAEFFNYTVRTLGLGEEWR

SEQ ID NO: 59084 - protein, 243 aa, Homo sapiens
MEKYADREDMIIMFVDSYDVILAGSPTELLKKFVQSGSRLLFSAESFCWPEWGLAEQYPEVGTGKRFLNSGGFIGFATTIHQIVRQWKYKDDDDDQLFYTRLYLDPGLREKLSLNLDHKSRIFQNLNGALDEVVLKFDRNRVRIRNVAYDTLPIVVHGNGPTKLQLNYLGNYVPNGWTPEGGCGFCNQDRRTLPGGPASPPGVSGRVCGTAYSVSAPLPAAAATPGLSPRQGHPFPAQQRGLP

SEQ ID NO: 59085 - protein, 254 aa, Homo sapiens [sequence omitted]

SEQ ID NO: 59086 - protein, 254 aa, Homo sapiens [sequence omitted]

SEQ ID NO: 59087 - protein, 254 aa, Homo sapiens [sequence omitted]

SEQ ID NO: 59088 - protein, 267 aa, Homo sapiens
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEVSKRYGGFMRGLKRSPQLEDEAKELQKRYGGFMRRVGRPEWWMDYQKRYGGFLKRFAEALPSDEEGESYSKEVPEMEKRYGGFMRF

SEQ ID NO: 59089 - protein, 267 aa, Homo sapiens; identical to SEQ ID NO: 59088

SEQ ID NO: 59090 - protein, 105 aa, Homo sapiens
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMK

SEQ ID NO: 59091 - protein, 189 aa, Homo sapiens
MARFLTLCTWLLLLGPGLLATVRAECSQDCATCSYRLVRPADINFLACVMECEGKLPSLKIWETCKELLQLSKPELPQDGTSTLRENSKPEESHLLAKRYGGFMKRYGGFMKKMDELYPMEPEEEANGSEILAKRYGGFMKKDAEEDDSLANSSDLLKELLETGDNRERSHHQDGSDNEEEKKKKKRKE

SEQ ID NO: 59092 - protein, 140 aa, Homo sapiens
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRVLVFVMGKEGVHGGGLNKKAYSMAKYLRDSGF

SEQ ID NO: 59093 - protein, 140 aa, Homo sapiens
MAGWQSYVDNLMCDGCCQEAAIVGYCDAKYVWAATAGGVFQSITPIEIDMIVGKDREGFFTNGLTLGAKKCSVIRDSLYVDGDCTMDIRTKSQGGEPTYNVAVGRAGRALVIVMGKEGVHGGTLNKKAYELALYLRRSDV

SEQ ID NO: 59094 - protein, 137 aa, Homo sapiens
MGDWKVYISAVLRDQRIDDVAIVGHADNSCVWASRPGGLLAAISPQEVGVLTGPDRHTFLQAGLSVGGRRCCVIRDHLLAEGDGVLDARTKGLDARAVCVGRAPRALLVLMGRRGVHGGILNKTVHELIRGLRMQGA

SEQ ID NO: 59095 - protein, 388 aa, Homo sapiens
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNQQGSSGGAVVFGGVDSSLYTGQIYWAPVTQELYWQIGIEEFLIGGQASGWCSEGCQAIVDTGTSLLTVPQQYMSALLQATGAQEDEYGQFLVNCNSIQNLPSLTFIINGVEFPLPPSSYILSNNGYCTVGVEPTYLSSQNGQPLWILGDVFLRSYYSVYDLGNNRVGFATAA

SEQ ID NO: 59096 - protein, 104 aa, Homo sapiens [sequence omitted]

SEQ ID NO: 59097 - protein, 136 aa, Homo sapiens
MKWMVVVLVCLQLLEAAVVKVPLKKFKSIRETMKEKGLLGEFLRTHKYDPAWKYRFGDLSVTYEPMAYMDVQSIQVPNQEFGLSENEPGTNFVYAQFDGIMGLAYPALSVDEATTAMQGMVQEGALTSPVFSVYLS

SEQ ID NO: 59098 - protein, 315 aa, Homo sapiens
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNLVLESSGLGPLLTPSRAAPPSSTLQLPEKPLEQTWNILTPFTKTLPVSNLSRKVTSWAGVGIPVTCLPEAGSGGERRAECGLGVPTTRGPPRSQHHSGA

SEQ ID NO: 59099 - protein, 180 aa, Homo sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 59100 - protein, 86 aa, Homo sapiens
MLCLLLTLGVALVCGVPAMDIPQTKQDLELPKDTTTPIQSMMCQYLARVLVEDDEIMQGFIRAFRPLPRHLWYLLDLKQMEAPCWL

SEQ ID NO: 59101 - protein, 180 aa, Homo sapiens; identical to SEQ ID NO: 59099

SEQ ID NO: 59102 - protein, 145 aa, Homo sapiens
MLCLLLTLGVALVCGVPAMDIPQTKQDLELPKAPLRVHITSLLPTPEDNLEIVLHRWENNSCVEKKVLGEKTENPKKFKINCKASGAPQLSWKPQGPRTDPASSTARVLVEDDEIMQGFIRAFRPLPRHLWYLLDLKQMEEPCRF

SEQ ID NO: 59103 - protein, 132 aa, Homo sapiens
LMATLKAPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 59104 - protein, 131 aa, Homo sapiens
  MOD_RES (1)..(1): Any amino acid
XVPAMDIPQTKQDLELPKAPLRVHITSLLPTPEDNLEIVLHRWENNSCVEKKVLGEKTENPKKFKINCKASGAPQLSWKPQGPRTDPASSTARVLVEDDEIMQGFIRAFRPLPRHLWYLLDLKQMEEPCRF

SEQ ID NO: 59105 - protein, 126 aa, Homo sapiens
  MOD_RES (1)..(1): Any amino acid
XPLRVHITSLLPTPEDNLEIVLHRWENNSCVEKKVLGEKTENPKKFKINYTVANEATLLDTDYDNFLFLCLQDTTTPIQSMMCQYLARVLVEDDEIMQGFIRAFRPLPRHLWYLLDLKQMEEPCRF

SEQ ID NO: 59106 - protein, 33 aa, Homo sapiens
  MOD_RES (1)..(1): Any amino acid
XEIMQGFIRAFRPLPRHLWYLLDLKQMEEPCRF

SEQ ID NO: 59107 - protein, 180 aa, Homo sapiens; identical to SEQ ID NO: 59099

SEQ ID NO: 59108 - protein, 169 aa, Homo sapiens
MLCLLLTLGVALVCGVPAMDIPQTKQDLELPKLAGTWHSMAMATNNISLMATLKAPLRVHITSLLPTPEDNLEIVLHRWENNSCVEKKVLGEKTENPKKFKINYTVANEATLLDTDYDNFLFLCLQDTTTPIQSMMCQYLESWWRTMRSCRDSSGLSGPCPGTYGTCWT

SEQ ID NO: 59109 - protein, 757 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRNLREARDNAVAEKERAVMAEKDALEKHDQLLDRYRELQLSTESKVTEFLHQSKLKSFESERVQLLQEETARNLTQCQLECEKYQKKLEVLTKEFYSLQASSEKRITELQAQNSEHQARLDIYEKLEKELDEIIMQTAEIENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 59110 - protein, 216 aa, Homo sapiens
FRTAKVENEDEAERVLFSYGYGANVPTTAKRRLKQSVHLARRVLQLEKQNSLILKDLEHRKDQVTQLSQELDRANSLLNQTQQPYRYLIESVRQRDSKIDSLTESIAQLEKDVSNLNKEKSALLQTKNQMALDLEQLLNHREELAAMKQILVKMHSKHSENSLLLTKTEPKHVTENQKSKTLNVPKEHEDNIFTPKPTLFTKKEAPEWSKKQKMKT

SEQ ID NO: 59111 - protein, 414 aa, Homo sapiens
MSRKISKESKKVNISSSLESEDISLETTVPTDDISSSEEREGKVRITRQLIERKELLHNIQLLKIELSQKTMMIDNLKVDYLTKIEELEEKLNDALHQKQLLTLRLDNQLAFQQKDASKYQELMKQEMETILLRQKQLEETNLQLREKAGDVRRNLRDFELTEEQYIKLKAFPEDQLSIPEYVSVRFYELVNPLRKEICELQVKKNILAEELSTNKNQLKQLTETYEEDRKNYSEVQIRCQRLALELADTKQLIQQGDYRQENYDKVKSERDALEQEVIELRRKHEILEASHMIQTKERSELSKEVVTLEQTVTLLQKDKEYLNRQNMELSVRCAHEEDRLERLQAQLEESKKAREEMYEKYVASRDHYKTEYENKLHDELEQIRLKTNQEIDQLRNASREMYERENRKKRKKK

SEQ ID NO: 59112 - protein, 195 aa, Homo sapiens
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPEGPYGVFAGRDASRGLATFCLDKEALKDEYDDLSDLTAAQQETLSDWESQFTFKYHHVGKLLKEGEEPTVYSDEEEPKDESARKND

SEQ ID NO: 59113 - protein, 143 aa, Homo sapiens
MAAEDVVATGADPSDLESGGLLHEIFTSPLNLLLLGLCIFLLYKIVRGDQPAASGDSDDDEPPPLPRLKRRDFTPAELRRFDGVQDPRILMAINGKVFDVTKGRKFYGPVKYHHVGKLLKEGEEPTVYSDEEEPKDESARKND

SEQ ID NO: 59114 - protein, 223 aa, Homo sapiens
MAAGDGDVKLGTLGSGSESSNDGGSESPGDAGAAAEGGGWAAAALALLTGGGEMLLNVALVALVLLGAYRLWVRWGRRGLGAGAGAGEESPATSLPRMKKRDFSLEQLRQYDGSRNPRILLAVNGKVFDVTKGSKFYGPAGPYGIFAGRDASRGLATFCLDKDALRDEYDDLSDLNAVQMESVREWEMQFKEKYDYVGRLLKPGEEPSEYTDEEDTKDHNKQD

SEQ ID NO: 59115 - protein, 133 aa, Homo sapiens
MAAGDGDVKLGTLGSGSESSNDGGSESPGDAGAAAEGGGWAAAALALLTGGGEMLLNVALVALVLLGAYRLWVRWGRRGLGAGAGAGLQLGAAAPVRRLPQPAHPARGQWESLRRDQRQQVLRPGGSIWNICW

SEQ ID NO: 59116 - protein, 247 aa, Homo sapiens
MGGAGRGVGEGRGRGGGGRRWRAVMAAGDGDVKLGTLGSGSESSNDGGSESPGDAGAAAEGGGWAAAALALLTGGGEMLLNVALVALVLLGAYRLWVRWGRRGLGAGAGAGEESPATSLPRMKKRDFSLEQLRQYDGSRNPRILLAVNGKVFDVTKGSKFYGPAGPYGIFAGRDASRGLATFCLDKDALRDEYDDLSDLNAVQMESVREWEMQFKEKYDYVGRLLKPGEEPSEYTDEEDTKDHNKQD

SEQ ID NO: 59117 - protein, 346 aa, Homo sapiens
MAMAQKLSHLLPSLRQVIQEPQLSLQPEPVFTVDRAEVPPLFWKPYIYAGYRPLHQTWRFYFRTLFQQHNEAVNVWTHLLAALVLLLRLALFVETVDFWGDPHALPLFIIVLASFTYLSFSALAHLLQAKSEFWHYSFFFLDYVGVAVYQFGSALAHFYYAIEPAWHAQVQAVFLPMAAFLAWLSCIGSCYNKYIQKPGLLGRTCQEVPSVLAYALDISPVVHRIFVSSDPTTDDPALLYHKCQVVFFLLAAAFFSTFMPERWFPGSCHVFGQGHQLFHIFLVLCTLAQLEAVALDYEARRPIYEPLHTHWPHNFSGLFLLTVGSSILTAFLLSQLVQRKLDQKTK

SEQ ID NO: 59118 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 59119 - protein, 179 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTGTIGARRTGQPLKEDPSAVPVFSVDYGELDFQWR

SEQ ID NO: 59120 - protein, 212 aa, Homo sapiens
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGKAINVFVSANRLIHQTNLILQTFKTVA

SEQ ID NO: 59121 - protein, 212 aa, Homo sapiens; identical to SEQ ID NO: 59120

SEQ ID NO: 59122 - protein, 146 aa, Homo sapiens
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVN

SEQ ID NO: 59123 - protein, 79 aa, Homo sapiens
MRMTMEEMKNEAETTSMVSMPLYAVMYPVFNELERVNLSAAQTLRAAFIKAEKENPGLTQDIIMKILEKKSVEVNFTES

SEQ ID NO: 59124 - protein, 212 aa, Homo sapiens; identical to SEQ ID NO: 59120

SEQ ID NO: 59125 - protein, 212 aa, Homo sapiens; identical to SEQ ID NO: 59120

SEQ ID NO: 59126 - protein, 202 aa, Homo sapiens
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGKAINVFVSANRLIHQTN

SEQ ID NO: 59127 - protein, 186 aa, Homo sapiens
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDIASAIKELLDTVNNVFKKYQYQNRRALEHQKKEFVKYSKSFSDTLKTYFKDGK

SEQ ID NO: 59128 - protein, 134 aa, Homo sapiens
MRMTMEEMKNEAETTSMVSMPLYAVMYPVFNELERVNLSAAQTLRAAFIKAEKENPGLTQDIIMKILEKKSVEVNFTESLLRMAADDVEEYMIERPEPEFQDLNEKARALKQILSKIPDEINDRVRFLQTIKDI

SEQ ID NO: 59129 - protein, 212 aa, Homo sapiens; identical to SEQ ID NO: 59120

SEQ ID NO: 59130 - protein, 1871 aa, Homo sapiens
MANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGQTVTCFLKKYNVVKKWLEVEIAPDIRGRIPLLLTSLSFKVLKHPDKKFRVGQALRATVVGPDSSKTLLCLSLTGPHKLEEGEVAMGRVVKVTPNEGLTVSFPFGKIGTVSIFHMSDSYSETPLEDFVPQKVVRCYILSTADNVLTLSLRSSRTNPETKSKVEDPEINSIQDIKEGQLLRGYVGSIQPHGVFFRLGPSVVGLARYSHVSQHSPSKKALYNKHLPEGKLLTARVLRLNHQKNLVELSFLPGDTGKPDVLSASLEGQLTKQEERKTEAEERDQKGEKKNQKRNEKKNQKGQEEVEMPSKEKQQPQKPQAQKRGGRECRESGSEQERVSKKPKKAGLSEEDDSLVDVYYREGKEEAEETNVLPKEKQTKPAEAPRLQLSSGFAWNVGLDSLTPALPPLAESSDSEEDEKPHQATIKKSKKERELEKQKAEKELSRIEEALMDPGRQPESADDFDRLVLSSPNSSILWLQYMAFHLQATEIEKARAVAERALKTISFREEQEKLNVWVALLNLENMYGSQESLTKVFERAVQYNEPLKVFLHLADIYAKSEKFQEAGELYNRMLKRFRQEKAVWIKYGAFLLRRSQAAASHRVLQRALECLPSKEHVDVIAKFAQLEFQLGDAERAKAIFENTLSTYPKRTDVWSVYIDMTIKHGSQKDVRDIFERVIHLSLAPKRMKFFFKRYLDYEKQHGTEKDVQAVKAKALEYVEAKSSVLED

SEQ ID NO: 59131 - protein, 1234 aa, Homo sapiens
MANLEESFPRGGTRKIHKPEKAFQQSVEQDNLFDISTEEGSTKRKKSQKGPAKTKKLKIEKRESSKSAREKFEILSVESLCEGMRILGCVKEVNELELVISLPNGLQGFVQVTEICDAYTKKLNEQVTQEQPLKDLLHLPELFSPGMLVRCVVSSLGITDRGKKSVKLSLNPKNVNRVLSAEALKPGMLLTGTVSSLEDHGYLVDIGVDGTRAFLPLLKAQEYIRQKNKGAKLKVGQYLNCIVEKVKGNGGVVSLSVGHSEVSTAIATEQQSWNLNNLLPGLVVKAQVQKVTPFGLTLNFLTFFTGVVDFMHLDPKKAGTYFSNQAVRACILCVHPRTRVVHLSLRPIFLQPGRPLTRLSCQNLGAVLDDVPVQGFFKKAGATFRLKDGVLAYARLSHLSDSKNVFNPEAFKPGNTHKCRIIDYSQMDELALLSLRTSIIEAQYLRYHDIEPGAVVKGTVLTIKSYGMLVKVGEQMRGLVPPMHLADILMKNPEKKYHIGDEVKCRVLLCDPEAKKLMMTLKKTLIESKLPVITCYADAKPGLQTHGFIIRVKDYGCIVKFYNNVQGLVPKHELSTEYIPDPERVFYTGQVVKVVVLNCEPSKERMLLSFKLSSDPEPKKEPAGHSQKKGKAINIGQLVDVKVLEKTKDGLEVAVLPHNIRAFLPTSHLSDHVANGPLLHHWLQAGDILHRVLCLSQSEGRVLLCRKPALVSTVEGGQDPKNFSEIHPGMLLIGFVKSIKDYGVFIQFPSGLSGLAPKAIMSDKFVTSTSDHFVEGQTVAAKVTNVDEEKQRMLLSLRLSDCGLGDLAITSLLLLNQCLEELQGVRSLMSNRDSVLIQTLAEMTPGMFLDLVVQEVLEDGSVVFSGGPVPDLVLKASRYHRAGQEVESGQKKKVVILNVDLLKLEVHVSLHQDLVNRKARKLRKGSEHQAIVQHLEKSFAIASLVETGHLAAFSLTSHLNDTFRFDSEKLQVGQGVSLTLKTTEPGVTGLLLAVEGPAAKRTMRPTQKDSETVDEDEEVDPALTVGTIKKHTLSIGDMVTGTVKSIKPTHVVVTLEDGIIGCIHASHILDDVPEGTSPTTKLKVGKTVTARVIGGRDMKTFKYLPISHPRFVRTIPELSVRPSELEDGHTALNTHSVSPMEKIKQYQAGLSEEDDSLVDVYYREGKEEAEETNVLPKEKQTKPAEAPRLQLSSGFAWNVGLDSLTPALPPLAESSDSEEDEKPHQATQIKKSKK

SEQ ID NO: 59132 - protein, 311 aa, Homo sapiens
MAAAGARPVELGFAESAPAWRLRSEQFPSKVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQVMPQLLNYLKADRLGKSIDWGILAVFTCAESCSLGTGYTEEFVWKQDVTDTP

SEQ ID NO: 59133 - protein, 228 aa, Homo sapiens
MAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGKQFQDFIH

SEQ ID NO: 59134 - protein, 344 aa, Homo sapiens
MAAAGARPVELGFAESAPAWRLRSEQFPSKVGGRPAWLGAAGLPGPQALACELCGRPLSFLLQVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGEALEEELDSMAKHESREDKIFQKFKTQIALEPEQILRYGRGIAPIWISGENIPQEKDIPDCPCGAKRILEFQVMPQLLNYLKADRLGKSIDWGILAVFTCAESCSLGTGYTEEFVWKQDVTDTP

SEQ ID NO: 59135 - protein, 195 aa, Homo sapiens
MAAAGARPVELGFAESAPAWRLRSEQFPSKVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGKQFQDFIH

SEQ ID NO: 59136 - protein, 188 aa, Homo sapiens
MAAAGARPVELGFAESAPAWRLRSEQFPSKVYAPLPGRPDAFHRCIFLFCCREQPCCAGLRVFRNQLPRKNDFYSYEPPSENPPPETGESVCLQLKSGAHLCRVCGCLGPKTCSRCHKAYYCSKEHQTLDWRLGHKQACAQPDHLDHIIPDHNFLFPEFEIVIETEDEIMPEVVEKEDYSEIIGSMGI

SEQ ID NO: 59137 - protein, 868 aa, Homo sapiens
MATFISVQLKKTSEVDLAKPLVKFIQQTYPSGGEEQAQYCRAAEELSKLRRAAVGRPLDKHEGALETLLRYYDQICSIEPKFPFSENQICLTFTWKDAFDKGSLFGGSVKLALASLGYEKSCVLFNCAALASQIAAEQNLDNDEGLKIAAKHYQFASGAFLHIKETVLSALSREPTVDISPDTVGTLSLIMLAQAQEVFFLKATRDKMKDAIIAKLANQAADYFGDAFKQCQYKDTLPKEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 59138 - protein, 873 aa, Homo sapiens
MATFISVQLKKTSEVDLAKPLVKFIQQTYPSGGEEQAQYCRAAEELSKLRRAAVGRPLDKHEGALETLLRYYDQICSIEPKFPFSENQICLTFTWKDAFDKGSLFGGSVKLALASLGYEKSCVLFNCAALASQIAAEQNLDNDEGLKIAAKHYQFASGAFLHIKETVLSALSREPTVDISPDTVGTLSLIMLAQAQEVFFLKATRDKMKDAIIAKLANQAADYFGDAFKQCQYKDTLPKYFYFQEVFPVLAAKHCIMQANAEYHQSILAKQQKKFGEEIARLQHAAELIKTVASRYDEYVNVKDFSDKINRALAAAKKDNDFIYHDRVPDLKDLDPIGKATLVKSTPVNVPISQKFTDLFEKMVPVSVQQSLAAYNQRKADLVNRSIAQMREATTLANGVLASLNLPAAIEDVSGDTVPQSILTKSRSVIEQGGIQTVDQLIKELPELLQRNREILDESLRLLDEEEATDNDLRAKFKERWQRTPSNELYKPLRAEGTNFRTVLDKAVQADGQVKECYQSHRDTIVLLCKPEPELNAAIPSANPAKTMQGSEVVNVLKSLLSNLDEVKKEREGLENDLKSVNFDMTSKFLTALAQDGVINEEALSVTELDRVYGGLTTKVQESLKKQEGLLKNIQVSHQEFSKMKQSNNEANLREEVLKNLATAYDNFVELVANLKEGTKFYNELTEILVRFQNKCSDIVFARKTERDELLKDLQQSIAREPSAPSIPTPAYQSSPAGGHAPTPPTPAPRTMPPTKPQPPARPPPPVLPANRAPSATAPSPVGAGTAAPAPSQTPGSAPPPQAQGPPYPTYPGYPGYCQMPMPMGYNPYAYGQYNMPYPPVYHQSPGQAPYPGPQQPSYPFPQPPQQSYYPQQ

SEQ ID NO: 59139 - protein, 485 aa, Homo sapiens
MALPPFFGQGRPGPPPPQPPPPAPFGCPPPPLPSPAFPPPLPQRPGPFPGASAPFLQPPLALQPRASAEASRGGGGAGAFYPVPPPPLPPPPPQCRPFPGTDAGERPRPPPPGPGPPWSPRWPEAPPPPADVLGDAALQRLRDRQWLEAVFGTPRRAGCPVPQRTHAGPSLGEVRARLLRALRLVRRLRGLSQALREAEADGAAWVLLYSQTAPLRAELAERLQPLTQAAYVGEARRRLERVRRRRLRLRERAREREAEREAEAARAVEREQEIDRWRVKCVQEVEEKKREQELKAAADGVLSEVRKKQADTKRMVDILRALEKLRKLRKEAAARKGVCPPASADETFTHHLQRLRKLIKKRSELYEAEERALRVMLEGEQEEERKRELEKKQRKEKEKILLQKREIESKLFGDPDEFPLAHLLEPFRQYYLQAEHSLPALIQIRHDWDQYLVPSDHPKGNFVPQGWVLPPLPSNDIWATAVKLH

SEQ ID NO: 59140 - protein, 279 aa, Homo sapiens
LMRSHSDSCHFSKHLRREHGPATILRPGSPRPPPPPSFSLRRLRERAREREAEREAEAARAVEREQEIDRWRVKCVQEVEEKKREQELKAAADGVLSEVRKKQADTKRMVDILRALEKLRKLRKEAAARKGVCPPASADETFTHHLQRLRKLIKKRSELYEAEERALRVMLEGEQEEERKRELEKKQRKEKEKILLQKREIESKLFGDPDEFPLAHLLEPFRQYYLQAEHSLPALIQIRHDWDQYLVPSDHPKGNFVPQGWVLPPLPSNDIWATAVKLH

SEQ ID NO: 59141 - protein, 270 aa, Homo sapiens
SHSDSCHFSKHLRREHGPATILRPGSPRRRRLRLRERAREREAEREAEAARAVEREQEIDRWRVKCVQEVEEKKREQELKAAADGVLSEVRKKQADTKRMVDILRALEKLRKLRKEAAARKGVCPPASADETFTHHLQRLRKLIKKRSELYEAEERALRVMLEGEQEEERKRELEKKQRKEKEKILLQKREIESKLFGDPDEFPLAHLLEPFRQYYLQAEHSLPALIQIRHDWDQYLVPSDHPKGNFVPQGWVLPPLPSNDIWATAVKLH

SEQ ID NO: 59142 - protein, 54 aa, Homo sapiens
MCTTLFLLSTLAMLWRRRFANRVQPEPSDVDGAARGSSLDADPQSSGREKEPLK

SEQ ID NO: 59143 - protein, 81 aa, Homo sapiens
MTRTESPATWMGQLGAAAWMRTLSPQAAQVLVRPLAQEDAVGAAAAARGRMGGSSTREVPRAHPVTGCSAEIINKKCQLDL

SEQ ID NO: 59144 - protein, 272 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAEDIAYQLSRSRNITYLPAGQSVLLQLPQ

SEQ ID NO: 59145 - protein, 246 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISAEGDSKAAELIANSLATAGDGLIELRKLEAAED

SEQ ID NO: 59146 - protein, 124 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITT

SEQ ID NO: 59147 - protein, 201 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVE

SEQ ID NO: 59148 - protein, 214 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKAEQQKKAAIISA

SEQ ID NO: 59149 - protein, 155 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITYLPAGQSVLLQLPQ

SEQ ID NO: 59150 - protein, 204 aa, Homo sapiens
MAAKVFESIGKFGLALAVAGGVVNSALYNVDAGHRAVIFDRFRGVQDIVVGEGTHFLIPWVQKPIIFDCRSRPRNVPVITGSKDLQNVNITLRILFRPVASQLPRIFTSIGEDYDERVLPSITTEILKSVVARFDAGELITQRELVSRQVSDDLTERAATFGLILDDVSLTHLTFGKEFTEAVEAKQVAQQEAERARFVVEKVS

SEQ ID NO: 59151 - protein, 299 aa, Homo sapiens
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVAQQEAQRAQFLVEKAKQEQRQKIVQAEGEAEAAKMLGEALSKNPGYIKLRKIRAAQNISKTIATSQNRIYLTADNLVLNLQDESFTRYSDSLIKGKK

SEQ ID NO: 59152 - protein, 261 aa, Homo sapiens
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVALSKNPGYIKLRKIRAAQNISKTIATSQNRIYLTADNLVLNLQDESFTRGSDSLIKGKK

SEQ ID NO: 59153 - protein, 299 aa, Homo sapiens
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVAQQEAQRAQFLVEKAKQEQRQKIVQAEGEAEAAKMLGEALSKNPGYIKLRKIRAAQNISKTIATSQNRIYLTADNLVLNLQDESFTRGSDSLIKGKK

SEQ ID NO: 59154 - protein, 213 aa, Homo sapiens
MAQNLKDLAGRLPAGPRGMGTALKLLLGAGAVAYGVRESVFTVEGGHRAIFFNRIGGVQQDTILAEGLHFRIPWFQYPIIYDIRARPRKISSPTGSKDLQMVNISLRVLSRPNAQELPSMYQRLGLDYEERVLPSIVNEVLKSVVAKFNASQLITQRAQVSLLIRRELTERAKDFSLILDDVAITELSFSREYTAAVEAKQVGESQEPWGEGF

SEQ ID NO: 59155 - protein, 105 aa, Homo sapiens
MRGATRVSIMLLLVTVSDCAVITGACERDVQCGAGTCCAISLWLRGLRMCTPLGREGEECHPGSHKVPFFRKRKHHTCPCLPNLLCSRFPDGRYRCSMDLKNINF

SEQ ID NO: 59156 - protein, 129 aa, Homo sapiens
MRSLCCAPLLLLLLLPPLLLTPRAGDAAVITGACDKDSQCGGGMCCAVSIWVKSIRICTPMGKLGDSCHPLTRKNNFGNGRQERRKRKRSKRKKEVPFFGRRMHHTCPCLPGLACLRTSFNRFICLAQK

SEQ ID NO: 59157 - protein, 108 aa, Homo sapiens
MRSLCCAPLLLLLLLPPLLLTPRAGDAAVITGACDKDSQCGGGMCCAVSIWVKSIRICTPMGKLGDSCHPLTRKVPFFGRRMHHTCPCLPGLACLRTSFNRFICLAQK

SEQ ID NO: 59158 - protein, 384 aa, Homo sapiens
MAAQNGNTSFTPNFNPPQDHASSLSFNFSYGDYDLPMDEDEDMTKTRTFFAAKIVIGIALAGIMLVCGIGNFVFIAALTRYKKLRNLTNLLIANLAISDFLVAIICCPFEMDYYVVRQLSWEHGHVLCASVNYLRTVSLYVSTNALLAIAIDRYLAIVHPLKPRMNYQTASFLIALVWMVSILIAIPSAYFATETVLFIVKSQEKIFCGQIWPVDQQLYYKSYFLFIFGVEFVGPVVTMTLCYARISRELWFKAVPGFQTEQIRKRLRCRRKTVLVLMCILTAYVLCWAPFYGFTIVRDFFPTVFVKEKHYLTAFYVVECIAMSNSMINTVCFVTVKNNTMKYFKKMMLLHWRPSQRGSKSSADLDLRTNGVPTTEEVDCIRLK

SEQ ID NO: 59159 - protein, 384 aa, Homo sapiens; identical to SEQ ID NO: 59158

SEQ ID NO: 59160 - protein, 227 aa, Homo sapiens
MNIKGSPWKGSLLLLLVSNLLLCQSVAPLPICPGGAARCQVTLRDLFDRAVVLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 59161 - protein, 196 aa, Homo sapiens
MNIKGSPWKGSLLLLLVSNLLLSHYIHNLSSEMFSEFDKRYTHGRGFITKAINSCHTSSLATPEDKEQAQQMNQKDFLSLIVSILRSWNEPLYHLVTEVRGMQEAPEAILSKAVEIEEQTKRLLEGMELIVSQVHPETKENEIYPVWSGLPSLQMADEESRLSAYYNLLHCLRRDSHKIDNYLKLLKCRIIHNNNC

SEQ ID NO: 59162 - protein, 376 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGDPLMLGASHYKNLKSYRPRKISSQGRLAVFTKATLTTVQ

SEQ ID NO: 59163 - protein, 349 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQEREQRQAQEARDS

SEQ ID NO: 59164 - protein, 521 aa, Homo sapiens
MKENVASATVFTLLLFLNTCLLNVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 59165 - protein, 268 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSGDPLMLGASHYKNLKSYRPRKISSQGRLAVFTKATLTTVQ

SEQ ID NO: 59166 - protein, 622 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEKGKSEELLSALGCQDFPPTSDYEDLLVEYLEVDDSEDQHLMSVHSKEHPSQGMKPTYLDPDTDSGRGSCDSPSLLSEKCEEPQANPSTFYDPEVIEKPENPETTHTWDPQCISMEGKIPYFHAGGSKCSTWPLPQPSQHNPRSSYHNITDVCELAVGPAGAPATLLNEAGKDALKSSQTIKSREEGKATQQREVESFHSETDQDTPWLLPQEKTPFGSAKPLDYVEIHKVNKDGALSLLPKQRENSGKPKKPGTPENNKEYAKVSGVMDNNILVLVPDPHAKNVACFEESAKEAPPSLEQNQAEKALANFTATSSKCRLQLGGLDYLDPACFTHSFH

SEQ ID NO: 59167 - protein, 197 aa, Homo sapiens
MHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSGDPLMLGASHYKNLKSYRPRKISSQGRLAVFTKATLTTVQ

SEQ ID NO: 59168 - protein, 103 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMV

SEQ ID NO: 59169 - protein, 62 aa, Homo sapiens
MKENVASATVFTLLLFLNTCLLNGQLPPGKPEIFKCRSPNKETFTCWWRPGTDGGLPTNYSL

SEQ ID NO: 59170 - protein, 111 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGS

SEQ ID NO: 59171 - protein, 521 aa, Homo sapiens; identical to SEQ ID NO: 59164

SEQ ID NO: 59172 - protein, 288 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEVTP

SEQ ID NO: 59173 - protein, 120 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVD

SEQ ID NO: 59174 - protein, 34 aa, Homo sapiens
MKENVASATVFTLLLFLNTCLLNGQLPPGKPEIF

SEQ ID NO: 59175 - protein, 309 aa, Homo sapiens
MKENVASATVFTLLLFLNTCLLNGQLPPGKPEIFKCRSPNKETFTCWWRPGTDGGLPTNYSLTYHREGETLMHECPDYITGGPNSCHFGKQYTSMWRTYIMMVNATNQMGSSFSDELYVDVTYIVQPDPPLELAVEVKQPEDRKPYLWIKWSPPTLIDLKTGWFTLLYEIRLKPEKAAEWEIHFAGQQTEFKILSLHPGQKYLVQVRCKPDHGYWSAWSPATFIQIPSDFTMNDTTVWISVAVLSAVICLIIVWAVALKGYSMVTCIFPPVPGPKIKGFDAHLLEDRLCTPGRCCVSTGLTDLDYSCST

SEQ ID NO: 59176 - protein, 417 aa, Homo sapiens
MGRRRAPELYRAPFPLYALQVDPSTGLLIAAGGGGAAKTGIKNGVHFLQLELINGRLSASLLHSHDTETRATMNLALAGDILAAGQDAHCQLLRFQAHQQQGNKAEKAGSKEQGPRQRKGAAPAEKKCGAETQHEGLELRVENLQAVQTDFSSDPLQKVVCFNHDNTLLATGGTDGYVRVWKVPSLEKVLEFKAHEGEIEDLALGPDGKLVTVGRDLKASVWQKDQLVTQLHWQENGPTFSSTPYRYQACRFGQVPDQPAGLRLFTVQIPHKRLRQPPPCYLTAWDGSNFLPLRTKSCGHEVVSCLDVSESGTFLGLGTVTGSVAIYIAFSLQCLYYVREAHGIVVTDVAFLPEKGRGPELLGSHETALFSVAVDSRCQLHLLPSRRSVPVWLLLLLCVGLIIVTILLLQSAFPGFL

SEQ ID NO: 59177 - protein, 417 aa, Homo sapiens; identical to SEQ ID NO: 59176

SEQ ID NO: 59178 - protein, 146 aa, Homo sapiens
MRLLQLLFRASPATLLLVLCLQLGANKAQDNTRKIIIKNFDIPKSVRPNDEVTAVLAVQTELKECMVVKTYLISSIPLQGAFNYKYTACLCDDNPKTFYWDFYTNRTVQIAAVVDVIRELGICPDDAAVIPIKNNRFYTIEILKVE

SEQ ID NO: 59179 - protein, 394 aa, Homo sapiens
MSGEDEQQEQTIAEDLVVTKYKMGGDIANRVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKASKTAENATSGETLEENEAGD

SEQ ID NO: 59180 - protein, 405 aa, Homo sapiens
ACPAPQPARSQLLALACLPAPLLARAFARPLLEDRGDSDHSPEDLVVTKYKMGGDIANRVLRSLVEASSSGVSVLSLCEKGDAMIMEETGKIFKKEKEMKKGIAFPTSISVNNCVCHFSPLKSDQDYILKEGDLVKIDLGVHVDGFIANVAHTFVVDVAQGTQVTGRKADVIKAAHLCAEAALRLVKPGNQNTQVTEAWNKVAHSFNCTPIEGMLSHQLKQHVIDGEKTIIQNPTDQQKKDHEKAEFEVHEVYAVDVLVSSGEGKAKDAGQRTTIYKRDPSKQYGLKMKTSRAFFSEVERRFDAMPFTLRAFEDEKKARMGVVECAKHELLQPFNVLYEKEGEFVAQFKFTVLLMPNGPMRITSGPFEPDLYKSEMEVQDAELKALLQSSASRKTQKKKKKKKKK

SEQ ID NO: 59181 - protein, 245 aa, Homo sapiens [sequence omitted]

SEQ ID NO: 59182 - protein, 600 aa, Homo sapiens
MALRRALPALRPCIPRFVPLSTAPASREQPAAGPAAVPGGGSATAVRPPVPAVDFGNAQEAYRSRRTWELARSLLVLRLCAWPALLARHEQLLYVSRKLLGQRLFNKLMKMTFYGHFVAGEDQESIQPLLRHYRAFGVSAILDYGVEEDLSPEEAEHKEMESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHRVYFGQLLGMCDQISFPLGQAGYPVYKYVPYGPVMEVLPYLSRRALENSSLMKGTHRERQLLWLELLRRLRTGNLFHRPA

SEQ ID NO: 59183 - protein, 492 aa, Homo sapiens
MKMTFYGHFVAGEDQESIQPLLRHYRAFGVSAILDYGVEEDLSPEEAEHKEMESCTSAAERDGSGTNKRDKQYQAHWAFGDRRNGVISARTYFYANEAKCDSHMETFLRCIEASGRVSDDGFIAIKLTALGRPQFLLQFSEVLAKWRCFFHQMAVEQGQAGLAAMDTKLEVAVLQESVAKLGIASRAEIEDWFTAETLGVSGTMDLLDWSSLIDSRTKLSKHLVVPNAQTGQLEPLLSRFTEEEELQMTRMLQRMDVLAKKATEMGVRLMVDAEQTYFQPAISRLTLEMQRKFNVEKPLIFNTYQCYLKDAYDNVTLDVELARREGWCFGAKLVRGAYLAQERARAAEIGYEDPINPTYEATNAMYHRCLDYVLEELKHNAKAKVMVASHNEDTVRFALRRMEELGLHPADHRVYFGQLLGMCDQISFPLGQAGYPVYKYVPYGPVMEVLPYLSRRALENSSLMKGTHRERQLLWLELLRRLRTGNLFHRPA

SEQ ID NO: 59184 - protein, 536 aa, Homo sapiens
MSPRVVSNSSVLASQSVGITNVRTVFSNVFNNTTAFPILRGSNCHKITAPGLGKGQLVNLLPPENLPWCGGSQGPRMLRTCYVLCSQAGPPSRGWQSLSFDGGAFHLKGTGELTRALLVLRLCAWPPLVTHGLLLQAWSRRLLGSRLSGAFLRASVYGQFVAGETAEEVKGCVQQLRTLSLRPLLAVPTEEEPDSAAKSGEAWYEGNLGAMLRCVDLSRGLLEPPSLAEASLMQLKVTALTSTRLCKELASWVRRPGASLELSPERLAEAMDSGQNLQVSCLNAEQNQHLRASLSRLHRVAQYARAQHVRLLVDAEYTSLNPALSLLVAALAVRWNSPGEGGPWVWNTYQACLKDTFERLGRDAEAAHRAGLAFGVKLVRGAYLDKERAVAQLHGMEDPTQPDYEATSQSYSRCLELMLTHVARHGPMCHLMVASHNEESVRQATKRMWELGIPLDGTVCFGQLLGMCDHVSLALGQAGYVVYKSIPYGSLEEVIPYLIRRAQENRSVLQGARREQELLSQELWRRLLPGCRRIPH

SEQ ID NO: 59185 - protein, 253 aa, Homo sapiens
MPGRTEGGSWLRNAAAADVLRNLPEVEWREPQHCCPPTPRKRKQNPRVPLPHYPPNPAAAIAADTMPKRKKQNHHQPPTQQQPPLPEREETGDEEDGSPIGPPSLLGPPPMANGKPGDPKSALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 59186 - protein, 167 aa, Homo sapiens
MPKRKKQNHHQPPTQQQPPLPEREETGDEEDGSPIALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 59187 - protein, 188 aa, Homo sapiens
MPKRKKQNHHQPPTQQQPPLPEREETGDEEDGSPIGPPSLLGPPPMANGKPGDPKSALHRGPPGSRGPLIPPLLSLPPPPWGRGPIRRGLGPRSSPYGRGWWGVNAEPPFPGPGHGGPTRGSFHKEQRNPRRLKSWSLIKNTCPPKDDPQVMEDKSDRPVCRHFAKKGHCRYEDLCAFYHPGVNGPPL

SEQ ID NO: 59188 - protein, 188 aa, Homo sapiens; identical to SEQ ID NO: 59187

SEQ ID NO: 59189 - protein, 167 aa, Homo sapiens; identical to SEQ ID NO: 59186

SEQ ID NO: 59190 - protein, 167 aa, Homo sapiens; identical to SEQ ID NO: 59186

SEQ ID NO: 59191 - protein, 167 aa, Homo sapiens; identical to SEQ ID NO: 59186

SEQ ID NO: 59192 - protein, 188 aa, Homo sapiens; identical to SEQ ID NO: 59187

SEQ ID NO: 59193 - protein, 188 aa, Homo sapiens; identical to SEQ ID NO: 59187

SEQ ID NO: 59194 - protein, 167 aa, Homo sapiens; identical to SEQ ID NO: 59186

SEQ ID NO: 59195 - protein, 167 aa, Homo sapiens; identical to SEQ ID NO: 59186

SEQ ID NO: 59196 - protein, 167 aa, Homo sapiens; identical to SEQ ID NO: 59186

SEQ ID NO: 59197 - protein, 188 aa, Homo sapiens; identical to SEQ ID NO: 59187

SEQ ID NO: 59198 - protein, 188 aa, Homo sapiens; identical to SEQ ID NO: 59187

SEQ ID NO: 59199 - protein, 188 aa, Homo sapiens; identical to SEQ ID NO: 59187

SEQ ID NO: 59200 - protein, 253 aa, Homo sapiens; identical to SEQ ID NO: 59185

SEQ ID NO: 59201 - protein, 253 aa, Homo sapiens; identical to SEQ ID NO: 59185

SEQ ID NO: 59202 - protein, 253 aa, Homo sapiens; identical to SEQ ID NO: 59185

SEQ ID NO: 59203 - protein, 253 aa, Homo sapiens; identical to SEQ ID NO: 59185

SEQ ID NO: 59204 - protein, 253 aa, Homo sapiens; identical to SEQ ID NO: 59185

SEQ ID NO: 59205 - protein, 253 aa, Homo sapiens; identical to SEQ ID NO: 59185

SEQ ID NO: 59206 - protein, 134 aa, Homo sapiens
MLLVLLSVVLLALSSAQSTDNDVNYEDFTFTIPDVEDSSQRPDQGPQRPPPEGLLPRPPGDSGNQDDGPQQRPPKPGGHHRHPPPPPFQNQQRPPRRGHRQLSLPRFPSVSLQEASSFFQRDRPARHPQEQPLW

SEQ ID NO: 59207 - protein, 126 aa, Homo sapiens
MLLVLLSVVLLALSSAQSTDNDVNYEDFTFTIPDVEDSYLDPLVIVVTKMMVLSRDHQNQEAITAILPHLLFKISNDHPDEDTVNSLYPDFLLSACRKHHHSSRGTDQQDIPRSNHSGNLEFSGRK

SEQ ID NO: 59208 - protein, 65 aa, Homo sapiens
MLLVLLSVVLLALSSAQSTDNDVNYEDFTFTIPACRKHHHSSRGTDQQDIPRSNHSGNLEFSGRK

SEQ ID NO: 59209 - protein, 231 aa, Homo sapiens
MAVFLEAKDAHSVLKRFPRANEFLEELRQGTIERECMEEICSYEEVKEVFENKEKTMEFWKGYPNAVYSVRDPSQSSDAMYVVVPLLGVALLIVIALFIIWRCQLQKATRHHPSYAQNRYLASRAGHTLPRVMVYRGTVHSQGEPSGHREAANSPQVVLGPSRGGRTTVRLESTLYLPELSLSRLSSTTPPPSYEEVTAPQESSSEEASVSYSDPPPKYEEIVAANPGADK

SEQ ID NO: 59210 - protein, 102 aa, Homo sapiens
MAGLSRALSSVFLEAKDAHSVLKRFPRANEFLEELRQGTIERECMEEICSYEEVKEVFENKEKTACTTLGLVLGVGVASGIARTGPGNADQSEARKDTQPKA

SEQ ID NO: 59211 - protein, 91 aa, Homo sapiens
DPSQSSDAMYVVVPLLGVALLIVIALFIIWRCQLQKATRHHPSYAQNRRCFAVRLAAPSFASKYSNVGAFPFRLWAASLSLARIYLTNIPK

SEQ ID NO: 59212 - protein, 52 aa, Homo sapiens
MAVFLEAKDAHSVLKRFPRANEFLEELRQGTIERECMEEICSYEEVKEVFEN

SEQ ID NO: 59213 - protein, 231 aa, Homo sapiens; identical to SEQ ID NO: 59209

SEQ ID NO: 59214 - protein, 226 aa, Homo sapiens
MFTLLVLLSQLPTVTLGFPHCARGPKASKHAGEEVFTSKEEANFFIHRRLLYNRFDLELFTPGNLERECNEELCNYEEAREIFVDEDKTIAFWQEYSAKGPTTKSDGNREKIDVMGLLTGLIAAGVFLVIFGLLGYYLCITKCNRLQHPCSSAVYERGRHTPSIIFRRPEEAALSPLPPSVEDAGLPSYEQAVALTRKHSVSPPPPYPGHTKGFRVFKKSMSLPSH

SEQ ID NO: 59215 - protein, 124 aa, Homo sapiens
MLLRDLVLRRGCCWSSLLLHCALHPLWGFVQVTHGEPQKSCSKVTDSCRHVCQCRPPPPLPPPPPPPPPPRLLSAPAPNSTSCPTEESWWSGLVIIIAVCCASLVFLTVLVIICYKAIKRNHAI

SEQ ID NO: 59216 - protein, 153 aa, Homo sapiens
MLLRDLVLRRGCCWSSLLLHCALHPLWGFVQVTHGEPQKSCSKVTDSCRHVCQCRPPPPLPPPPPPPPPPRLLSAPAPNSTSCPTEESWWSGLVIIIAVCCASLVFLTVLVIICYKAIKRKPLRKDENGTSVAEYPMSASQSNKGVDVNNAVV

SEQ ID NO: 59217 - protein, 153 aa, Homo sapiens; identical to SEQ ID NO: 59216

SEQ ID NO: 59218 - protein, 275 aa, Homo sapiens
MWRAGSMSAELGVGCALRAVNERVQQAVARRPRDLPAIQPRLVAVSKTKPADMVIEAYGHGQRTFGENYVQELLEKASNPKILSLCPEIKWHFIGHLQKQNVNKLMAVPNLFMLETVDSVKLADKVNSSWQRKGSPERLKVMVQINTSGEESKHGLPPSETIAIVEHINAKCPNLEFVGLMTIGSFGHDLSQGPNPDFQLLLSLREELCKKLNIPADQVELSMGMSADFQHAVEVGSTNVRIGSTIFGERDYSKKPTPDKCAADVKAPLEVAQEH

SEQ ID NO: 59219 - protein, 382 aa, Homo sapiens
MRSPLCWLLPLLILASVAQGQPTRRPRPGTGPGRRPRPRPRPTPSFPQPDEPAEPTDLPPPLPPGPPSIFPDCPRECYCPPDFPSALYCDSRNLRKVPVIPPRIHYLYLQNNFITELPVESFQNATGLRWINLDNNRIRKIDQRVLEKLPGLVFLYMEKNQLEEVPSALPRNLEQLRLSQNHISRIPPGVFSKLENLLLLDLQHNRLSDGVFKPDTFHGLKNLMQLNLAHNILRKMPPRVPTAIHQLYLDSNKIETIPNGYFKSFPNLAFIRLNYNKLTDRGLPKNSFNISNLLVLHLSHNRISSVPAINNRLEHLYLNNNSIEKINGTQICPNDLVAFHDFSSDLENVPHLRYLRLDGNYLKPPIPLDLMMCFRLLQSVVI

SEQ ID NO: 59220 - protein, 333 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASPPTPIRSVLAPQPSTSNSQRLPRPQGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 59221 - protein, 310 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRACQPNATHQPECATWQRCPTSGFSVNSKRASKTKHCRTQSAGKWTQGSCFPATKSSCHGCHSQQSAAPQESGSPRTYQVKRSGQQARLQ

SEQ ID NO: 59222 - protein, 333 aa, Homo sapiens; identical to SEQ ID NO: 59220

SEQ ID NO: 59223 - protein, 333 aa, Homo sapiens; identical to SEQ ID NO: 59220

SEQ ID NO: 59224 - protein, 333 aa, Homo sapiens; identical to SEQ ID NO: 59220

SEQ ID NO: 59225 - protein, 221 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLR

SEQ ID NO: 59226 - protein, 232 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASPPTPIRSVLAPQPSTSNSQR

SEQ ID NO: 59227 - protein, 363 aa, Homo sapiens
MEDLEEDVRFIVDETLDFGGLSPSDSREEEDITVLVTPEKPLRRGLSHRSDPNAVAPAPQGVRLSLGPLSPEKLEEILDEANRLAAQLEQCALQDRESAGEGLGPRRVKPSPRRETFVLKDSPVRDLLPTVNSLTRSTPSPSSLTPRLRSNDRKGSVRALRATSGKRPSNMKRESPTCNLFPASKSPASSPLTRSTPPVRGRAGPSGRAAASEETRAAKLRVSGSGEFVGLTLKFLHPSPPGPPTPIRSVLAPQPSTSNSQRLPRPQGAAAKSSSQLPIPSAIPRPASRMPLTSRSVPPGRGALPPDSLSTRKGLPRPSTAGHRVRESGHKVPVSQRLNLPVMGATRSNLQPPRKVAVPGPTR

SEQ ID NO: 59228 - protein, 90 aa, Homo sapiens
MRRLLLVTSLVVVLLWEAGAVPAPKVPIKMQVKHWPSEQDPEKAWGARVVEPPEKDDQLVVLFPVQKPKLLTTEEKPRGTKAWMESRARP

SEQ ID NO: 59229 - protein, 152 aa, Homo sapiens
MRRLLLVTSLVVVLLWEAGAVPAPKVPIKMQVKHWPSEQDPENRAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 59230 - protein, 151 aa, Homo sapiens
MRRLLLVTSLVVVLLWEAGAVPAPKVPIKMQVKHWPSEQDPEKAWGARVVEPPEKDDQLVVLFPVQKPKLLTTEEKPRGQGRGPILPGTKAWMETEDTLGHVLSPEPDHDSLYHPPPEEDQGEERPRLWVMPNHQVLLGPEEDQDHIYHPQ

SEQ ID NO: 59231 - protein, 142 aa, Homo sapiens
MRRLLLVTSLVVVLLWEAGAVPAPKVPIKMQVKHWPSEQDPEKAWGARVVEPPEKDDQLVVLFPVQKPKLLTTEEKPRGTKAWMETEDTLGHVLSPEPDHDSLYHPPPEEDQGEERPRLWVMPNHQVLLGPEEDQDHIYHPQ

SEQ ID NO: 59232 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGLALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59233 - protein, 1382 aa, Homo sapiens
MLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGLALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59234 - protein, 2157 aa, Homo sapiens; identical to SEQ ID NO: 59232

SEQ ID NO: 59235 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQHTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPSLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59236 - protein, 2157 aa, Homo sapiens; identical to SEQ ID NO: 59235

SEQ ID NO: 59237 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59238 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPLESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59239 - protein, 2157 aa, Homo sapiens; identical to SEQ ID NO: 59235

SEQ ID NO: 59240 - protein, 2149 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSITSKQWRRPGTPSLHPYRSQPLYLPPGPAPPSALLSGLALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59241 - protein, 2157 aa, Homo sapiens; identical to SEQ ID NO: 59235

SEQ ID NO: 59242 - protein, 2157 aa, Homo sapiens; identical to SEQ ID NO: 59235

SEQ ID NO: 59243 - protein, 2157 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59244 - protein, 2138 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSITSKQWRRPGTPSLHPYRSQPLYLPPGPAPPSALLSGLALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59245 - protein, 2157 aa, Homo sapiens; identical to SEQ ID NO: 59235

SEQ ID NO: 59246 - protein, 2157 aa, Homo sapiens; identical to SEQ ID NO: 59238

SEQ ID NO: 59247 - protein, 2157 aa, Homo sapiens; identical to SEQ ID NO: 59243

SEQ ID NO: 59248 - protein, 2157 aa, Homo sapiens; identical to SEQ ID NO: 59237

SEQ ID NO: 59249 - protein, 2149 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSITSKQWRRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59250 - protein, 549 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAASEVPLMEDSRGQQRDPPRGLEAPHP

SEQ ID NO: 59251 - protein, 2138 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQHTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSVTSKQWRRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPSLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59252 - protein, 2149 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQHTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSVTSKQWRRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPSLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59253 - protein, 549 aa, Homo sapiens; identical to SEQ ID NO: 59250

SEQ ID NO: 59254 - protein, 549 aa, Homo sapiens; identical to SEQ ID NO: 59250

SEQ ID NO: 59255 - protein, 1382 aa, Homo sapiens
MLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQHTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPSLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59256 - protein, 2138 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPLESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSITSKQWRRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59257 - protein, 2138 aa, Homo sapiens; identical to SEQ ID NO: 59251

SEQ ID NO: 59258 - protein, 2138 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPETEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSITSKQWRRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59259 - protein, 2138 aa, Homo sapiens; identical to SEQ ID NO: 59251

SEQ ID NO: 59260 - protein, 2138 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSITSKQWRRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59261 - protein, 1382 aa, Homo sapiens
MLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGLPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59262 - protein, 2149 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSITSKQWRRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59263 - protein, 2149 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPLESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMYPPYLPFPPPYGPQGPYRYPTPDGPSRFPRVAGPRGSGPPMRLVEPVGRPSILKEDNLKEFDQLDQENDDGWAGAHEEVDYTEKLKFSDEEDGRDSDEEGAEGHRDSQSASGEERPPEADGKKGNSPNSEPPTPKTAWAETSRPPETEPGPPAPKPPLPPPHRGPAGNWGPPGDYPDRGGPPCKPPAPEDEDEAWRQRRKQSSSEISLAVERARRRREEEERRMQEERRAACAEKLKRLDEKFGAPDKRLKAEPAAPPAAPSTPAPPPAVPKELPAPPAPPPASAPTPEKEPEEPAQAPPAQSTPTPGVAAAPTLVSGGGSTSSTSSGSFEASPVEPQLPSKEGPEPPEEVPPPTTPPVPKVEPKGDGIGPTRQPPSQGLGYPKYQKSLPPRFQRQQQEQLLKQQQQHQWQQHQQGSAPPTPVPPSPPQPVTLGAVPAPQAPPPPPKALYPGALGRPPPMPPMNFDPRWMMIPPYVDPRLLQGRPPLDFYPPGVHPSGLVPRERSDSGGSSSEPFDRHAPAMLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGAAGNSAVTESFEEMMGVEVGQGDQTTLLLPEAALPARHGARVQSMRKSPSGAGSGAQKQAARPMRVIWLLQTRRLPHPRREHSPRSRSPTTRSPTFPAPARFTPGVGESSLPEGISPGPRRREPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGHGLSITSKQWRRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59264 - protein, 1382 aa, Homo sapiens
MLRERGTPPVDPKLAWVGDVFTATPAEPRPLTSPLRQAADEDDKGMRSETPPVPPPPPYLASYPGFPENGAPGPPISRFPLEEPGPRPLPWPPGSDEVAKIQTPPPKKEPPKEETAQLTGPEAGRKPARGVGSGGQGPPPPRRESRTETRWGPRPGSSRRGIPPEEPGAPPRRAGPIKKPPPPTKVEELPPKPLEQGDETPKPPKPDPLKITKGKLGGPKETPPNGNLSPAPRLRRDYSYERVGPTSCRGRGRGEYFARGRGFRGTYGGRGRGARSREFRSYREFRGDDGRGGGTGGPNHPPAPRGRTASETRSEGSEYEEIPKRRRQRGSETGSETHESDLAPSDKEAPTPKEGTLTQVPLAPPPPGAPPSPAPARFTARGGRVFTPRGVPSRRGRGGGRPPPQVCPGWSPPAKSLAPKKPPTGPLPPSKEPLKEKLIPGPLSPVARGGSNGGSNVGMEDGERPRRRRHGRAQQQDKPPRFRRLKQERENAARGSEGKPSLTLPASAPGPEEALTTVTVAPAPRRAAAKSPDLSNQNSDQANEEWETASESSDFTSERRGDKEAPPPVLLTPKAVGTPGGGGGGAVPGISAMSRGDLSQRAKDLSKRSFSSQRPGMERQNRRPGPGGKAGSSGSSSGGGGGGPGGRTGPGRGDKRSWPSPKNRSRPPEERPPGLPLPPPPPSSSAVFRLDQVIHSNPAGIQQALAQLSSRQGSVTAPGGHPRHKPGPPQAPQGPSPRPPTRYEPQRVNSGLSSDPHFEEPGPMVRGVGGTPRDSAGVSPFPPKRRERPPRKPELLQEESLPPPHSSGFLGSKPEGPGPQAESRDTGTEALTPHIWNRLHTATSRKSYRPSSMEPWMEPLSPFEDVAGTEMSQSDSGVDLSGDSQVSSGPCSQRSSPDGGLKGAAEGPPKRPGGSSPLNAVPCEGPPGSEPPRRPPPAPHDGDRKELPREQPLPPGPIGTERSQRTDRGTEPGPIRPSHRPGPPVQFGTSDKDSDLRLVVGDSLKAEKELTASVTEAIPVSRDWELLPSAAASAEPQSKNLDSGHCVPEPSSSGQRLYPEVFYGSAGPSSSQISGGAMDSQLHPNSGGFRPGTPSLHPYRSQPLYLPPGPAPPSALLSGVALKGQFLDFSTMQATELGKLPAGGVLYPPPSFLYSPAFCPSPLPDTSLLQVRQDLPSPSDFYSTPLQPGGQSGFLPSGAPAQQMLLPMVDSQLPVVNFGSLPPAPPPAPPPLSLLPVGPALQPPSLAVRPPPAPATRVLPSPARPFPASLGRAELHPVELKPFQDYQKLSSNLGGPGSSRTPPTGRSFSGLNSRLKATPSTYSGVFRTQRVDLYQQASPPDALRWIPKPWERTGPPPREGPSRRAEEPGSRGDKEPGLPPPR

SEQ ID NO: 59265 - protein, 1382 aa, Homo sapiens; identical to SEQ ID NO: 59264

SEQ ID NO: 59266 - protein, 2149 aa, Homo sapiens; identical to SEQ ID NO: 59252

SEQ ID NO: 59267 - protein, 1382 aa, Homo sapiens; identical to SEQ ID NO: 59255

SEQ ID NO: 59268 - protein, 2149 aa, Homo sapiens; identical to SEQ ID NO: 59252

SEQ ID NO: 59269 - protein, 549 aa, Homo sapiens; identical to SEQ ID NO: 59250

SEQ ID NO: 59270 - protein, 549 aa, Homo sapiens; identical to SEQ ID NO: 59250

SEQ ID NO: 59271 - protein, 1382 aa, Homo sapiens; identical to SEQ ID NO: 59255

SEQ ID NO: 59272 - protein, 327 aa, Homo sapiens
MTVVSVPQREPLVLGGRLAPLGFSSRGYFGALPMVTTAPPPLPRIPDPRALPPTLFLPHFLGGDGPCLTPQPRAPAALPNRSLAVAGGTPRAAPKKRRKKKVRASPAGQLPSRFHQYQQHRPSLEGGRSPATGPSGAQEVPGPAAALAPSPAAAAGTEGASPDLAPLRPAAPGQTPLRKEVLKSKMGKSEKIALPHGQLVHGIHLYEQPKINRQKSKYNLPLTKITSAKRNENNFWQDSVSSDRIQKQEKKPFKNTENIKNSHLKKSAFLTEVSQKENYAGAKFSDPPSPSVLPKPPSHWMGSTVENSNQNRELMAVHLKTLLKVQT

SEQ ID NO: 59273 - protein, 142 aa, Homo sapiens
MGKSEKIALPHGQLVHGIHLYEQPKINRQKSKYNLPLTKITSAKRNENNFWQDSVSSDRIQKQEKKPFKNTENIKNSHLKKSAFLTEVSQKENYAGAKFSDPPSPSVLPKPPSHWMGSTVENSNQNRELMAVHLKTLLKVQT

SEQ ID NO: 59274 - protein, 142 aa, Homo sapiens; identical to SEQ ID NO: 59273

SEQ ID NO: 59275 - protein, 139 aa, Homo sapiens
MGGGERYNIPAPQSRNVSKNQQQLNRQKTKEQNSQMKIVHKKKERGHGYNSSAAAWQAMQNGGKNKNFPNNQSWNSSLSGPRLLFKSQANQNYAGAKFSEPPSPSVLPKPPSHWVPVSFNPSDKEIMTFQLKTLLKVQV

SEQ ID NO: 59276 - protein, 139 aa, Homo sapiens; identical to SEQ ID NO: 59275

SEQ ID NO: 59277 - protein, 198 aa, Homo sapiens
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGKPQGPPPQGGNKPQGPPPPGKPQGPPAQGGSKSQSARSPPGKPQGPPQQEGNNPQGPPPPAGGNPQQPQAPPAGQPQGPPRPPQGGRPSRPPQ

SEQ ID NO: 59278 - protein, 178 aa, Homo sapiens
MLLILLSVALLALSSAQNLNEDVSQEESPSLIAGNPQGPSPQGGNKPQGPPPPPGKPQGPPPQGGNKPQGPPPPGKPQGPPPQGDKSRSPRSPPGKPQGPPPQGGKPQGPPAQGGSKSQSARSPPGKPQGPPQQEGNNPQGPPPPAGGNPQQPQAPPAGQPQGPPRPPQGGRPSRPPQ

SEQ ID NO: 59279 - protein, 198 aa, Homo sapiens; identical to SEQ ID NO: 59277

SEQ ID NO: 59280 - protein, 416 aa, Homo sapiens
MLLILLSVALLALSSAQNLNEDVSQEESPSLIAGNPQGAPPQGGNKPQGPPSPPGKPQGPPPQGGNQPQGPPPPPGKPQGPPPQGGNKPQGPPPPGKPQGPPPQGDKSRSPRSPPGKPQGPPPQGGNQPQGPPPPPGKPQGPPPQGGNKPQGPPPPGKPQGPPPQGDNKSRSSRSPPGKPQGPPPQGGNQPQGPPPPPGKPQGPPPQGGNKPQGPPPPGKPQGPPPQGDNKSQSARSPPGKPQGPPPQGGNQPQGPPPPPGKPQGPPPQGGNKPQGPPPPGKPQGPPPQGGSKSRSSRSPPGKPQGPPPQGGNQPQGPPPPPGKPQGPPPQGGNKPQGPPPPGKPQGPPPQGGSKSRSARSPPGKPQGPPQQEGNNPQGPPPPAGGNPQQPQAPPAGQPQGPPRPPQGGRPSRPPQ

SEQ ID NO: 59281 - protein, 247 aa, Homo sapiens
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGTPPPPGKPERPPPQGGNQSHRPPPPPGKPERPPPQGGNQSQGPPPHPGKPEGPPPQEGNKSRSARSPPGKPQGPPQQEGNKPQGPPPPGKPQGPPPAGGNPQQPQAPPAGKPQGPPPPPQGGRPPRPAQGQQPPQ

SEQ ID NO: 59282 - protein, 247 aa, Homo sapiens; identical to SEQ ID NO: 59281

SEQ ID NO: 59283 - protein, 178 aa, Homo sapiens
MLLILLSVALLALSSAESSSEDVSQEESLFLISGKPEGRRPQGGNQPQRPPPPPGKPQGPPPQGGNQSQGPPPPPGKPEGRPPQGGNQSQGPPPHPGKPERPPPQGGNQSQGKPQGPPQQEGNKPQGPPPPGKPQGPPPAGGNPQQPQAPPAGKPQGPPPPPQGGRPPRPAQGQQPPQ

SEQ ID NO: 59284 - protein, 166 aa, Homo sapiens
MLLILLSVALLAFSSAQDLNEDVSQEDVPLVISDGGDSEQFLDEERQGPPLGGQQSQPSAGDGNQDDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 59285 - protein, 96 aa, Homo sapiens
MLLILLSVALLAFSSAQDLDEDVSQEDVPLVISDGGDSEQFIDEEGHKDHPNREAISKVLPHLLLESPRDHLPKGAAHKDLHRGSLLSNLGFNDRK

SEQ ID NO: 59286 - protein, 166 aa, Homo sapiens
MLLILLSVALLAFSSAQDLDEDVSQEDVPLVISDGGDSEQFIDEERQGPPLGGQQSQPSAGDGNQNDGPQQGPPQQGGQQQQGPPPPQGKPQGPPQQGGHPPPPQGRPQGPPQQGGHPRPPRGRPQGPPQQGGHQQGPPPPPPGKPQGPPPQGGRPQGPPQGQSPQ

SEQ ID NO: 59287 - protein, 166 aa, Homo sapiens; identical to SEQ ID NO: 59286

SEQ ID NO: 59288 - protein, 299 aa, Homo sapiens
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMVSPMGP

SEQ ID NO: 59289 - protein, 340 aa, Homo sapiens
MAASSSEISEMKGVEESPKVPGEGPGHSEAETGPPQVLAGVPDQPEAPQPGPNTTAAPVDSGPKAGLAPETTETPAGASETAQATDLSLSPGGESKANCSPEDPCQETVSKPEVSKEATADQGSRLESAAPPEPAPEPAPQPDPRPDSQPTPKPALQPELPTQEDPTPEILSESVGEKQENGAVVPLQAGDGEEGPAPEPHSPPSKKSPPANGAPPRVLQQLVEEDRMRRAHSGHPGSPRGSLSRHPSSQLAGPGVEGGEGTQKPRDYIILAILSCFCPMWPVNIVAFAYAVMSRNSLQQGDVDGAQRLGRVAKLLSIVALVGGVLIIIASCVINLGVYK

SEQ ID NO: 59290 - protein, 396 aa, Homo sapiens
MPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPGEVRLADSAASRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 59291 - protein, 416 aa, Homo sapiens
MMPQLQFKDAFWCRDFTAHTGYEVLLQRLLDGRKMCKDMEELLRQRAQAEERYGKELVQIARKAGGQTEINSLRASFDSLKQQMENVGSSHIQLALTLREELRSLEEFRERQKEQRKKYEAVMDRVQKSKLSLYKKAMESKKTYEQKCRDADDAEQAFERISANGHQKQVEKSQNKARQCKDSATEAERVYRQSIAQLEKVRAEWEQEHRTTCEAFQLQEFDRLTILRNALWVHSNQLSMQCVKDDELYEEVRLTLEGCSIDADIDSFIQAKSTGTEPPAPVPYQNYYDREVTPLTSSPGIQPSCGMIKRFSGLLHGSPKTTSLAASAASTETLTPTPERNEGVYTAIAVQEIQGNPASPAQEYRALYDYTAQNPDELDLSAGDILEVILEGEDGWWTVERNGQRGFVPGSYLEKL

SEQ ID NO: 59292 - protein, 534 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 59293 - protein, 534 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLRRATISNPITGDLETVHYRISKSAWLSGYENPVVSRINMRIQDLTGLDVSTAEELQVANYGVGGQYEPHFDFARKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 59294 - protein, 534 aa, Homo sapiens; identical to SEQ ID NO: 59292

SEQ ID NO: 59295 - protein, 534 aa, Homo sapiens; identical to SEQ ID NO: 59293

SEQ ID NO: 59296 - protein, 534 aa, Homo sapiens; identical to SEQ ID NO: 59293

SEQ ID NO: 59297 - protein, 516 aa, Homo sapiens
MIWYILIIGILLPQSLAHPGFFTSIGQMTDLIHTEKDLVTSLKDYIKAEEDKLEQIKKWAEKLDRLTSTATKDPEGFVGHPVNAFKLMKRLNTEWSELENLVLKDMSDGFISNLTIQRQYFPNDEDQVGAAKALLRLQDTYNLDTDTISKGNLPGVKHKSFLTAEDCFELGKVAYTEADYYHTELWMEQALRQLDEGEISTIDKVSVLDYLSYAVYQQGDLDKALLLTKKLLELDPEHQRANGNLKYFEYIMAKEKDVNKSASDDQSDQKTTPKKKGVAVDYLPERQKYEMLCRGEGIKMTPRRQKKLFCRYHDGNRNPKFILAPAKQEDEWDKPRIIRFHDIISDAEIEIVKDLAKPRLSRATVHDPETGKLTTAQYRVSKSAWLSGYENPVVSRINMRIQDLTGLDVSTAEELQKDEPDAFKELGTGNRIATWLFYMSDVSAGGATVFPEVGASVWPKKGTAVFWYNLFASGEGDYSTRHAACPVLVGNKWVSNKWLHERGQEFRRPCTLSELE

SEQ ID NO: 59298 - protein, 535 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRNDERDTFKHLGTGNRVATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 59299 - protein, 533 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATTTKSQVLDYLSYAVFQLGDLHRALELTRRLLSLDPSHERAGGNLRYFEQLLEEEREKTLTNQTEAELATPEGIYERPVDYLPERDVYESLCRGEGVKLTPRRQKRLFCRYHHGNRAPQLLIAPFKEEDEWDSPHIVRYYDVMSDEEIERIKEIAKPKLARATVRDPKTGVLTVASYRVSKSSWLEEDDDPVVARVNRRMQHITGLTVKTAELLQVANYGVGGQYEPHFDFSRRPFDSGLKTEGNRLATFLNYMSDVEAGGATVFPDLGAAIWPKKGTAVFWYNLLRSGEGDYRTRHAACPVLVGCKWVSNKWFHERGQEFLRPCGSTEVD

SEQ ID NO: 59300 - protein, 533 aa, Homo sapiens; identical to SEQ ID NO: 59299

SEQ ID NO: 59301 - protein, 533 aa, Homo sapiens; identical to SEQ ID NO: 59299

SEQ ID NO: 59302 - protein, 535 aa, Homo sapiens; identical to SEQ ID NO: 59298

SEQ ID NO: 59303 - protein, 167 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVD

SEQ ID NO: 59304 - protein, 535 aa, Homo sapiens; identical to SEQ ID NO: 59298

SEQ ID NO: 59305 - protein, 101 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALE

SEQ ID NO: 59306 - protein, 204 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYHTVLWMEQVLKQLDAGEEATT

SEQ ID NO: 59307 - protein, 114 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIA

SEQ ID NO: 59308 - protein, 147 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDP

SEQ ID NO: 59309 - protein, 50 aa, Homo sapiens
MKLWVSALLMAWFGVLSCVQAEFFTSIGHMTDLIYAEKELVQSLKEYILV

SEQ ID NO: 59310 - protein, 184 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRGELPGTKYQAMLSVDDCFGMGRSAYNEGDYYH

SEQ ID NO: 59311 - protein, 153 aa, Homo sapiens
MKLWVSALLMAWFGVLSCVQAEFFTSIGHMTDLIYAEKELVQSLKEYILVEEAKLSKIKSWANKMEALTSKSAADAEGYLAHPVNAYKLVKRLNTDWPALEDLVLQDSAAGFIANLSVQRQFFPTDEDEIGAAKALMRLQDTYRLDPGTISRG

SEQ ID NO: 59312 - protein, 544 aa, Homo sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRNAALFWWNLHRSGEGDSDTLHAGCPVLVGDKWVANKWIHEYGQEFRRPCSSSPED

SEQ ID NO: 59313 - protein, 604 aa, Homo sapiens
MGPGARLAALLAVLALGTGDPERAAARGDTFSALTSVARALAPERRLLGLLRRYLRGEEARLRDLTRFYDKVLSLHEDSTTPVANPLLAFTLIKRLQSDWRNVVHSLEASENIRALKDGYEKVEQDLPAFEDLEGAARALMRLQDVYMLNVKGLARGVFQRVTGSAITDLYSPKRLFSLTGDDCFQVGKVAYDMGDYYHAIPWLEEAVSLFRGSYGEWKTEDEASLEDALDHLAFAYFRAGNVSCALSLSREFLLYSPDNKRMARNVLKYERLLAESPNHVVAEAVIQRPNIPHLQTRDTYEGLCQTLGSQPTLYQIPSLYCSYETNSNAYLLLQPIRKEVIHLEPYIALYHDFVSDSEAQKIRELAEPWLQRSVVASGEKQLQVEYRISKSAWLKDTVDPKLVTLNHRIAALTGLDVRPPYAEYLQVVNYGIGGHYEPHFDHATSPSSPLYRMKSGNRVATFMIYLSSVEAGGATAFIYANLSVPVVRHCFGGTCTGVVKGTVTHFMLAVLSWWEISGWPTSGYMSMDRNSADPAAPALKTELLAERSWWSPVAFQRSQEPKAGVGEEKAEQPPGRRPCQLCLCLANQRQGRGCYQGTLRMYI

SEQ ID NO: 59314 - protein, 508 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 59315 - protein, 492 aa, Homo sapiens
MLRRALLCLAVAALVRADAPEEEDHKYLLVEFYAPWCGHCKALAPEYAKAAGKLKAEGSEIRLAKVDATEESDLAQQYGVRGYPTIKFFRNGDTASPKEYTAGREADDIVNWLKKRTGPAATTLPDGAAAESLVESSEVAVIGFFKDVESDSAKQFLQAAEAIDDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 59316 - protein, 451 aa, Homo sapiens
MLRRALLCLAVAALVRADAPEEEDHVLVLRKSNFAEALAAHKYLLVEFYAPWCGHCKALAPEYAKAAGKLKAEGSEIRLAKVDATEESDLAQQYGVRGYPTIKFFRNGDTASPKEYTAGREADDIPFGITSNSDVFSKYQLDKDGVVLFKKFDEGRNNFEGEVTKENLLDFIKHNQLPLVIEFTEQTAPKIFGGEIKTHILLFLPKSVSDYDGKLSNFKTAAESFKGKILFIFIDSDHTDNQRILEFFGLKKEECPAVRLITLEEEMTKYKPESEELTAERITEFCHRFLEGKIKPHLMSQELPEDWDKQPVKVLVGKNFEDVAFDEKKNVFVEFYAPWCGHCKQLAPIWDKLGETYKDHENIVIAKMDSTANEVEAVKVHSFPTLKFFPASADRTVIDYNGERTLDGFKKFLESGGQDGAGDDDDLEDLEEAEEPDMEEDDDQKAVKDEL

SEQ ID NO: 59317 - protein, 710 aa, Homo sapiens
MLSLQYPDVYRDETAVQDYHGHKICDPYAWLEDPDSEQTKAFVEAQNKITVPFLEQCPIRGLYKERMTELYDYPKYSCHFKKGKRYFYFYNTGLQNQRVLYVQDSLEGEARVFLDPNILSDDGTVALRGYAFSEDGEYFAYGLSASGSDWVTIKFMKVDGAKELPDVLERVKFSCMAWTHDGKGMFYNSYPQQDGKSDGTETSTNLHQKLYYHVLGTDQSEDILCAEFPDEPKWMGGAELSDDGRYVLLSIREGCDPVNRLWYCDLQQESSGIAGILKWVKLIDNFEGEYDYVTNEGTVFTFKTNRQSPNYRVINIDFRDPEESKWKVLVPEHEKDVLEWIACVRSNFLVLCYLHDVKNILQLHDLTTGALLKTFPLDVGSIVGYSGQKKDTEIFYQFTSFLSPGIIYHCDLTKEELEPRVFREVTVKGIDASDYQTVQIFYPSKDGTKIPMFIVHKKGIKLDGSHPAFLYGYGGFNISITPNYSVSRLIFVRHMGGILAVANIRGGGEYGETWHKGGILANKQNCFDDFQCAAEYLIKEGYTSPKRLTINGGSNGGLLVAACANQRPDLFGCVIAQVGVMDMLKFHKYTIGHAWTTDYGCSDSKQHFEWLVKYSPLHNVKLPEADDIQYPSMLLLTADHDDRVVPLHSLKFIATLQYIVGRSRKQSNPLLIHVDTKAGHGAGKPTAKVIEEVSDMFAFIARCLNVDWIP

SEQ ID NO: 59318 - protein, 45 aa, Homo sapiens
  MOD_RES (1)..(1): Any amino acid
XIIYHCDLTKEELEPRVFREVTVKGIDASDYQTVQLPKGTESSRN

SEQ ID NO: 59319 - protein, 44 aa, Homo sapiens
IIYHCDLTKEELEPRVFREVTVKGIDASDYQTVQLPKGTESSRN

SEQ ID NO: 59320 - protein, 727 aa, Homo sapiens
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 59321 - protein, 665 aa, Homo sapiens
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 59322 - protein, 661 aa, Homo sapiens
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 59323 - protein, 727 aa, Homo sapiens; identical to SEQ ID NO: 59320

SEQ ID NO: 59324 - protein, 727 aa, Homo sapiens; identical to SEQ ID NO: 59320

SEQ ID NO: 59325 - protein, 727 aa, Homo sapiens; identical to SEQ ID NO: 59320

SEQ ID NO: 59326 - protein, 727 aa, Homo sapiens; identical to SEQ ID NO: 59320

SEQ ID NO: 59327 - protein, 727 aa, Homo sapiens; identical to SEQ ID NO: 59320

SEQ ID NO: 59328 - protein, 151 aa, Homo sapiens
MQQKTKLFLQALKYSIPHLGKCMQKQHLNHYNFADHCYNRIKLKKYHLTKCLQNKPKISELARNIPSRSFSCKDLQPVKQENEKPLPENMDAFEKVRTKLETQPQEEYEIINVEVKHGGFVYYQEGCCLVRSKDEEADNDNYEVLFNLEEL

SEQ ID NO: 59329 - protein, 638 aa, Homo sapiens
MDAFEKVRTKLETQPQEEYEIINVEVKHGGFVYYQEGCCLVRSKDEEADNDNYEVLFNLEELKLDQPFIDCIRVAPDEKYVAAKIRTEDSEASTCVIIKLSDQPVMEASFPNVSSFEWVKDEEDEDVLFYTFQRNLRCHDVYRATFGDNKRNERFYTEKDPSYFVFLYLTKDSRFLTINIMNKTTSEVWLIDGLSPWDPPVLIQKRIHGVLYYVEHRDDELYILTNVGEPTEFKLMRTAADTPAIMNWDLFFTMKRNTKVIDLDMFKDHCVLFLKHSNLLYVNVIGLADDSVRSLKLPPWACGFIMDTNSDPKNCPFQLCSPIRPPKYYTYKFAEGKLFEETGHEDPITKTSRVLRLEAKSKDGKLVPMTVFHKTDSEDLQKKPLLVHVYGAYGMDLKMNFRPERRVLVDDGWILAYCHVRGGGELGLQWHADGRLTKKLNGLADLEACIKTLHGQGFSQPSLTTLTAFSAGGVLAGALCNSNPELVRAVTLEAPFLDVLNTMMDTTLPLTLEELEEWGNPSSDEKHKNYIKRYCPYQNIKPQHYPSIHITAYENDERVPLKGIVSYTEKLKEAIAEHAKDTGEGYQTPNIILDIQPGGNHVIEDSHKKITAQIKFLYEELGLDSTSVFEDLKKYLKF

SEQ ID NO: 59330 - protein, 496 aa, Homo sapiens
MGRRALLLLLLSFLAPWATIALRPALRALGSLHLPTNPTSLPAVAKNYSVLYFQQKVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 59331 - protein, 517 aa, Homo sapiens
MGRRALLLLLLSFLAPWATIALRPALRALGSLHLPTNPTSLPAVAKNYSVLYFQQKALAAGQLHICIIQLNHYKTPLVDHFGFNTVKTFNQRYLVADKYWKKNGGSILFYTGNEGDIIWFCNNTGFMWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 59332 - protein, 391 aa, Homo sapiens
MWDVAEELKAMLVFAEHRYYGESLPFGDNSFKDSRHLNFLTSEQALADFAELIKHLKRTIPGAENQPVIAIGGSYGGMLAAWFRMKYPHMVVGALAASAPIWQFEDLVPCGVFMKIVTTDFRKSGPHCSESIHRSWDAINRLSNTGSGLQWLTGALHLCSPLTSQDIQHLKDWISETWVNLAMVDYPYASNFLQPLPAWPIKVVCQYLKNPNVSDSLLLQNIFQALNVYYNYSGQVKCLNISETATSSLGTLGWSYQACTEVVMPFCTNGVDDMFEPHSWNLKELSDDCFQQWGVRPRPSWITTMYGGKNISSHTNIVFSNGELDPWSGGGVTKDITDTLVAVTISEGAHHLDLRTKNALDPMSVLLARSLEVRHMKNWIRDFYDSAGKQH

SEQ ID NO: 59333 - protein, 475 aa, Homo sapiens
MEGLLTRCRALPALATCSRQLSGYVPCRFHHCAPRRGRRLLLSRVFQPQNLREDRVLSLQDKSDDLTCKSQRLMLQVGLIYPASPGCYHLLPYTVRAMEKLVRVIDQEMQAIGGQKVNMPSLSPAELWQATNRWDLMGKELLRLRDRHGKEYCLGPTHEEAITALIASQKKLSYKQLPFLLYQVTRKFRDEPRPRFGLLRGREFYMKDMYTFDSSPEAAQQTYSLVCDAYCSLFNKLGLPFVKVQADVGTIGGTVSHEFQLPVDIGEDRLAICPRCSFSANMETLDLSQMNCPACQGPLTKTKGIEVGHTFYLGTKYSSIFNAQFTNVCGKPTLAEMGCYGLGVTRILAAAIEVLSTEDCVRWPSLLAPYQACLIPPKKGSKEQAASELIGQLYDHITEAVPQLHGEVLLDDRTHLTIGNRLKDANKFGYPFVIIAGKRALEDPAHFEVWCQNTGEVAFLTKDGVMDLLTPVQTV

SEQ ID NO: 59334 - protein, 165 aa, Homo sapiens
MAKMNLSSYILILTFSLFSQGILLSASKSIRNLDDDMVFNTFRLGKGFQKEDTAEKSVIAPSLEQYKNDESSFMNEEENKVSKNTGSKHNFLNHGLPLNLAIKPYLALKGSVAFPAENGVQNTESTQEKREIGDEENSAKFPIGRRDFDMLRCMLGRVYRPCWQV

SEQ ID NO: 59335 - protein, 865 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 59336 - protein, 856 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNMENGNNGYHKDHVYGIHNPVMTSPSQH

SEQ ID NO: 59337 - protein, 856 aa, Homo sapiens; identical to SEQ ID NO: 59336

SEQ ID NO: 59338 - protein, 58 aa, Homo sapiens
MALVLGSLLLLGLCGNSFSGGQPSSTDAPKAWNYELPATNYETQDSHKAGPIGILFEL

SEQ ID NO: 59339 - protein, 40 aa, Homo sapiens
MALVLGSLLLLGLCGNSFSGGQPSSTDAPKAWNYELPATN

SEQ ID NO: 59340 - protein, 865 aa, Homo sapiens; identical to SEQ ID NO: 59335

SEQ ID NO: 59341 - protein, 14 aa, Homo sapiens
MALVLGSLLLLGLC

SEQ ID NO: 59342 - protein, 834 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDPSQH

SEQ ID NO: 59343 - protein, 842 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKPETVILGLKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDVETIPMKNPSQH

SEQ ID NO: 59344 - protein, 830 aa, Homo sapiens
MALVLGSLLLLGLCGNSFSGGQPSSTDAPKAWNYELPATNYETQDSHKAGPIGILFELVHIFLYVVQPRDFPEDTLRKFLQKAYESKIDYDKIVYYEAGIILCCVLGLLFIILMPLVGYFFCMCRCCNKCGGEMHQRQKENGPFLRKCFAISLLVICIIISIGIFYGFVANHQVRTRIKRSRKLADSNFKDLRTLLNETPEQIKYILAQYNTTKDKAFTDLNSINSVLGGGILDRLRPNIIPVLDEIKSMATAIKETKEALENMNSTLKSLHQQSTQLSSSLTSVKTSLRSSLNDPLCLVHPSSETCNSIRLSLSQLNSNPELRQLPPVDAELDNVNNVLRTDLDGLVQQGYQSLNDIPDRVQRQTTTVVAGIKRVLNSIGSDIDNVTQRLPIQDILSAFSVYVNNTESYIHRNLPTLEEYDSYWWLGGLVICSLLTLIVIFYYLGLLCGVCGYDRHATPTTRGCVSNTGGVFLMVGVGLSFLFCWILMIIVVLTFVFGANVEKLICEPYTSKELFRVLDTPYLLNEDWEYYLSGKLFNKSKMKLTFEQVYSDCKKNRGTYGTLHLQNSFNISEHLNINEHTGSISSELESLKVNLNIFLLGAAGRKNLQDFAACGIDRMNYDSYLAQTGKSPAGVNLLSFAYDLEAKANSLPPGNLRNSLKRDAQTIKTIHQQRVLPIEQSLSTLYQSVKILQRTGNGLLERVTRILASLDFAQNFITNNTSSVIIEETKKYGRTIIGYFEHYLQWIEFSISEKVASCKPVATALDTAVDVFLCSYIIDPLNLFWFGIGKATVFLLPALIFAVKLAKYYRRMDSEDVYDDSSWVTSVQC

SEQ ID NO: 59345 - protein, 226 aa, Homo sapiens
MEAERRRQAEKPKKGRVGSNLLPERHPATGTPTTTVDSSAPPCRRLPGAGGGRSRFSPQGGQRGRPHSRRRHRTTFSPVQLEQLESAFGRNQYPDIWARESLARDTGLSEARIQVWFQNRRAKQRKQERSLLQPLAHLSPAAFSSFLPESTACPYSYAAPPPPVTCFPHPYSHALPSQPSTGGAFALSHQSEDWYPTLHPAPAGHLPCPPPPPMLPLSLEPSKSWN

SEQ ID NO: 59346 - protein, 138 aa, Homo sapiens
NISLCPEICFQKIESQVYFVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENS

SEQ ID NO: 59347 - protein, 120 aa, Homo sapiens
MSIQFLGTVYKVNILTRLAAELNKFMLEKVTEDTSSVLRSPMPGVVVAVSVKPGDAATSSLSVEICLFWTFQVAEGQEICVIEAMKMQNSMTAGKTGTVKSVHCQAGDTVGEGDLLVELE

SEQ ID NO: 59348 - protein, 681 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVVAEGQEICVIEAMKMQNSMTAGKTGTVKSVHCQAGDTVGEGDLLVELE

SEQ ID NO: 59349 - protein, 728 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 59350 - protein, 702 aa, Homo sapiens
MAGFWVGTAPLVAAGRRGRWPPQQLMLSAALRTLKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 59351 - protein, 84 aa, Homo sapiens
  MOD_RES (1)..(1): Any amino acid
XNWELSVKLHDKVHTVVASNNGSVFSVEVDGSKLNVTSTWNLASPLLSVSVDGTQRTVQCLSREAGGNMSIQFLGTVPWRKLLD

SEQ ID NO: 59352 - protein, 111 aa, Homo sapiens
YKVNILTRLAAELNKFMLEKVTEDTSSVLRSPMPGVVVAVSVKPGDAATSSLSVEICLFWTFQVAEGQEICVIEAMKMQNSMTAGKTGTVKSVHCQAGDTVGEGDLLVELE

SEQ ID NO: 59353 - protein, 134 aa, Homo sapiens
  MOD_RES (1)..(1): Any amino acid
XMPVIKPDIANWELSVKLHDKVHTVVASNNGSVFSVEVDGSKLNVTSTWNLASPLLSVSVDGTQRTVQCLSREAGGNMSIQFLGTVVAEGQEICVIEAMKMQNSMTAGKTGTVKSVHCQAGDTVGEGDLLVELE

SEQ ID NO: 59354 - protein, 102 aa, Homo sapiens
SDVYPDGFKGHMLTKSEKNQLLAIASSLFVAFQLRAQHFQENSRMPVIKPDIANWELSVKLHDKVHTVVASNNGSVFSVEVDGSKLNVTSTWNLFALIVCQR

SEQ ID NO: 59355 - protein, 539 aa, Homo sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 59356 - protein, 559 aa, Homo sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQQIIGWAQWLPLVISALWEAEDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 59357 - protein, 550 aa, Homo sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVRVQEVFHQVVQSGHRDGRGAVRW

SEQ ID NO: 59358 - protein, 128 aa, Homo sapiens
MSLRLDTTPSCNSARPLHALQVLLLLSLLLTALASSTKGQTKRNLAKGKEESLDSDLYAELRCMCIKTTSGIHPKNIQSLEVIGKGTHCNQVEVIATLKDGRKICLDPDAPRIKKIVQKKLAGDESAD

SEQ ID NO: 59359 - protein, 753 aa, Homo sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 59360 - protein, 158 aa, Homo sapiens
MERRAWSLQCTAFVLFCAWCALNSAKAKRQFVNEWAAEIPGGPEAASAIAEELGYDLLGQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITG

SEQ ID NO: 59361 - protein, 706 aa, Homo sapiens
MGKGSISFLFFSQIGSLENHYLFKHKNHPRRSRRSAFHITKRLSDDDRVIWAEQQYEKERSKRSALRDSALNLFNDPMWNQQWYLQDTRMTAALPKLDLHVIPVWQKGITGKGVVITVLDDGLEWNHTDIYANYDPEASYDFNDNDHDPFPRYDPTNENKHGTRCAGEIAMQANNHKCGVGVAYNSKVGGIRMLDGIVTDAIEASSIGFNPGHVDIYSASWGPNDDGKTVEGPGRLAQKAFEYGVKQGRQGKGSIFVWASGNGGRQGDNCDCDGYTDSIYTISISSASQQGLSPWYAEKCSSTLATSYSSGDYTDQRITSADLHNDCTETHTGTSASAPLAAGIFALALEANPNLTWRDMQHLVVWTSEYDPLANNPGWKKNGAGLMVNSRFGFGLLNAKALVDLADPRTWRSVPEKKECVVKDNDFEPRALKANGEVIIEIPTRACEGQENAIKSLEHVQFEATIEYSRRGDLHVTLTSAAGTSTVLLAERERDTSPNGFKNWDFMSVHTWGENPIGTWTLRITDMSGRIQNEGRIVNWKLILHGTSSQPEHMKQPRVYTSYNTVQNDRRGVEKMVDPGEEQPTQENPKENTLVSKSPSSSSVGGRRDELEEGAPSQAMLRLLQSAFSKNSPPKQSPKKSPSAKLNIPYENFYEALEKLNKPSQLKDSEDSLYNDYVDVFYNTKPYKHRDDRLLQALVDILNEEN

SEQ ID NO: 59362 - protein, 260 aa, Homo sapiens
MAGSPLLWGPRAGGVGLLVLLLLGLFRPPPALCARPVKEPRGLSAASPPLAETGAPRRFRRSVPRGEAAGAVQELARALAHLLEAERQERARAEAQEAEDQQARVLAQLLRVWGAPRNSDPALGLDDDPDAPAAQLARALLRARLDPAALAAQLVPAPVPAAALRPRPPVYDDGPAGPDAEEAGDETPDVDPELLRYLLGRILAGSADSEGVAAPRRLRRAADHDVGSELPPEGVLGALLRVKRLETPAPQVPARRLLPP

SEQ ID NO: 59363 - protein, 638 aa, Homo sapiens
MKGGCVSQWKAAAGFLFCVMVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 59364 - protein, 619 aa, Homo sapiens
MVFASAERPVFTNHFLVELHKGGEDKARQVAAEHGFGVRKLPFAEGLYHFYHNGLAKAKRRRSLHHKQQLERDPRVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 59365 - protein, 603 aa, Homo sapiens
MKGGCVSQWKAAAGFLFCVMVFASAERPVFTNHFLVELHKGGEDKARQVAAEHGFGVRKVKMALQQEGFDRKKRGYRDINEIDINMNDPLFTKQWYLINTGQADGTPGLDLNVAEAWELGYTGKGVTIGIMDDGIDYLHPDLASNYNAEASYDFSSNDPYPYPRYTDDWFNSHGTRCAGEVSAAANNNICGVGVAYNSKVAGIRMLDQPFMTDIIEASSISHMPQLIDIYSASWGPTDNGKTVDGPRELTLQAMADGVNKGRGGKGSIYVWASGDGGSYDDCNCDGYASSMWTISINSAINDGRTALYDESCSSTLASTFSNGRKRNPEAGVATTDLYGNCTLRHSGTSAAAPEAAGVFALALEANLGLTWRDMQHLTVLTSKRNQLHDEVHQWRRNGVGLEFNHLFGYGVLDAGAMVKMAKDWKTVPERFHCVGGSVQDPEKIPSTGKLVLTLTTDACEGKENFVRYLEHVQAVITVNATRRGDLNINMTSPMGTKSILLSRRPRDDDSKVGFDKWPFMTTHTWGEDARGTWTLELGFVGSAPQKGVLKEWTLMLHGTQSAPYIDQVVRDYQSKLAMSKKEELEEELDEAVERSLKSILNKN

SEQ ID NO: 59366 - protein, 755 aa, Homo sapiens
MRPAPIALWLRLVLALALVRPRAVGWAPVRAPIYVSSWAVQVSQGNREVERLARKFGFVNLGPIFPDGQYFHLRHRGVVQQSLTPHWGHRLHLKKNPKVQWFQQQTLQRRVKRSVVVPTDPWFSKQWYMNSEAQPDLSILQAWSQGLSGQGIVVSVLDDGIEKDHPDLWANYDPLASYDFNDYDPDPQPRYTPSKENRHGTRCAGEVAAMANNGFCGVGVAFNARIGGVRMLDGTITDVIEAQSLSLQPQHIHIYSASWGPEDDGRTVDGPGILTREAFRRGVTKGRGGLGTLFIWASGNGGLHYDNCNCDGYTNSIHTLSVGSTTQQGRVPWYSEACASTLTTTYSSGVATDPQIVTTDLHHGCTDQHTGTSASAPLAAGMIALALEANPFLTWRDMQHLVVRASKPAHLQAEDWRTNGVGRQVSHHYGYGLLDAGLLVDTARTWLPTQPQRKCAVRVQSRPTPILPLIYIRENVSACAGLHNSIRSLEHVQAQLTLSYSRRGDLEISLTSPMGTRSTLVAIRPLDVSTEGYNNWVFMSTHFWDENPQGVWTLGLENKGYYFNTGTLYRYTLLLYGTAEDMTARPTGPQVTSSACVQRDTEGLCQACDGPAYILGQLCLAYCPPRFFNHTRLVTAGPGHTAAPALRVCSSCHASCYTCRGGSPRDCTSCPPSSTLDQQQGSCMGPTTPDSRPRLRAAACPHHRCPASAMVLSLLAVTLGGPVLCGMSMDLPLYAWLSRARATPTKPQVWLPAGT

SEQ ID NO: 59367 - protein, 378 aa, Homo sapiens [sequence omitted]

SEQ ID NO: 59368 - protein, 913 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDATEESWAEGGFCMLVKKNNLCQRKVLQQLCCKTCTFQG

SEQ ID NO: 59369 - protein, 1590 aa, Homo sapiens
MGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNEAVSTANLSVVKSLLQERRRWKVQIKRDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 59370 - protein, 690 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGELASSGTQAKKRQLMHHPTTWENRMEWNGMKWNGMKWNGMEWNGMEWNRIESNRIE

SEQ ID NO: 59371 - protein, 690 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGELASSGTQAKKRQLMHHPTTWENRMEWNGMKWNGMEWNGMEWNGMESNRIESNRIE

SEQ ID NO: 59372 - protein, 1560 aa, Homo sapiens
NSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNEAVSTANLSVVKSLLQERRRWKVQIKRDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 59373 - protein, 101 aa, Homo sapiens
CQPCHRFCATCAGAGADGCINCTEGYFMEDGRCVQSCSISYYFDHSSENGYKSCKKCDISCLTCNGPGFKNCTSCPSGYLLDLGMCQMGAICKDVSLFRGA

SEQ ID NO: 59374 - protein, 1860 aa, Homo sapiens
MGWGSRCCCPGRLDLLCVLALLGGCLLPVCRTRVYTNHWAVKIAGGFPEANRIASKYGFINIGQIGALKDYYHFYHSRTIKRSVISSRGTHSFISMEPKVEWIQQQVVKKRTKRDYDFSRAQSTYFNDPKWPSMWYMHCSDNTHPCQSDMNIEGAWKRGYTGKNIVVTILDDGIERTHPDLMQNYDALASCDVNGNDLDPMPRYDASNENKHGTRCAGEVAAAANNSHCTVGIAFNAKIGGVRMLDGDVTDMVEAKSVSFNPQHVHIYSASWGPDDDGKTVDGPAPLTRQAFENGVRMGRRGLGSVFVWASGNGGRSKDHCSCDGYTNSIYTISISSTAESGKKPWYLEECSSTLATTYSSGESYDKKIITTDLRQRCTDNHTGTSASAPMAAGIIALALEANPFLTWRDVQHVIVRTSRAGHLNANDWKTNAAGFKVSHLYGFGLMDAEAMVMEAEKWTTVPRQHVCVESTDRQIKTIRPNSAVRSIYKASGCSDNPNRHVNYLEHVVVRITITHPRRGDLAIYLTSPSGTRSQLLANRLFDHSMEGFKNWEFMTIHCWGERAAGDWVLEVYDTPSQLRNFKTPGKLKEWSLVLYGTSVQPYSPTNEFPKVERFRYSRVEDPTDDYGTEDYAGPCDPECSEVGCDGPGPDHCNDCLHYYYKLKNNTRICVSSCPPGHYHADKKRCRKCAPNCESCFGSHGDQCMSCKYGYFLNEETNSCVTHCPDGSYQDTKKNLCRKCSENCKTCTEFHNCTECRDGLSLQGSRCSVSCEDGRYFNGQDCQPCHRFCATCAGAGADGCINCTEGYFMEDGRCVQSCSISYYFDHSSENGYKSCKKCDISCLTCNGPGFKNCTSCPSGYLLDLGMCQMGAICKDGEYVDEHGHCQTCEASCAKCQGPTQEDCTTCPMTRIFDDGRCVSNCPSWKFEFENQCHPCHHTCQRCQGSGPTHCTSCGADNYGREHFLYQGECGDSCPEGHYATEGNTCLPCPDNCELCHSVHVCTRCMKGYFIAPTNHTCQKLECGQGEVQDPDYEECVPCEEGCLGCSLDDPGTCTSCAMGYYRFDHHCYKTCPEKTYSEEVECKACDSNCGSCDQNGCYWCEEGFFLLGGSCVRKCGPGFYGDQEMGECESCHRACETCTGPGHDECSSCQEGLQLLRGMCVHATKTQEEGKFWNDILRKLQPCHSSCKTCNGSATLCTSCPKGAYLLAQACVSSCPQGTWPSVRSGSCENCTEACAICSGADLCKKCQMQPGHPLFLHEGRCYSKCPEGSYAEDGICERCSSPCRTCEGNATNCHSCEGGHVLHHGVCQENCPERHVAVKGVCKHCPEMCQDCIHEKTCKECTPEFFLHDDMCHQSCPRGFYADSRHCVPCHKDCLECSGPKADDCELCLESSWVLYDGLCLEECPAGTYYEKETKECRDCHKSCLTCSSSGTCTTCQKGLIMNPRGSCMANEKCSPSEYWDEDAPGCKPCHVKCFHCMGPAEDQCQTCPMNSLLLNTTCVKDCPEGYYADEDSNRCAHCHSSCRTCEGRHSRQCHSCRPGWFQLGKECLLQCREGYYADNSTGRCERCNRSCKGCQGPRPTDCLSCDRFFFLLRSKGECHRSCPDHYYVEQSTQTCERCHPTCDQCKGKGALNCLSCVWSYHLMGGICTSDCLVGEYRVGEGEKFNCEKCHESCMECKGPGAKNCTLCPANLVLHMDDSHCLHCCNTSDPPSAQECCDCQDTTDECILRTSKVRPATEHFKTALFITSSMMLVLLLGAAVVVWKKSRGRVQPAAKAGYEKLADPNKSYSSYKSSYRESTSFEEDQVIEYRDRDYDEDDDDDIVYMGQDGTVYRKFKYGLLDDDDIDELEYDDESYSYYQ

SEQ ID NO: 59375 - protein, 498 aa, Homo sapiens
IWNVHHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEERFVSTLSILFHWSVYLSWSQYHIVLITVAL

SEQ ID NO: 59376 - protein, 651 aa, Homo sapiens
MPPRAPPAPGPRPPPRAAAATDTAAGAGGAGGAGGAGGPGFRPLAPRPWRWLLLLALPAACSPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGDLETPVANQLTTEEREPGLKHVFRWQIEQELW

SEQ ID NO: 59377 - protein, 968 aa, Homo sapiens
MPPRAPPAPGPRPPPRAAAATDTAAGAGGAGGAGGAGGPGFRPLAPRPWRWLLLLALPAACSPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTAQSTPGSANILQTSVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 59378 - protein, 955 aa, Homo sapiens
MPPRAPPAPGPRPPPRAAAATDTAAGAGGAGGAGGAGGPGFRPLAPRPWRWLLLLALPAACSPPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGKLKEWSLILYGTAEHPYHTFSAHQSRSRMLELSAPELEPPKAALSPSQVEVPEDEEDYTGVCHPECGDKGCDGPNADQCLNCVHFSLGSVKTSRKCVSVCPLGYFGDTAARRCRRCHKGCETCSSRAATQCLSCRRGFYHHQEMNTCVTLCPAGFYADESQKNCLKCHPSCKKCVDEPEKCTVCKEGFSLARGSCIPDCEPGTYFDSELIRCGECHHTCGTCVGPGREECIHCAKNFHFHDWKCVPACGEGFYPEEMPGLPHKVCRRCDENCLSCAGSSRNCSRCKTGFTQLGTSCITNHTCSNADETFCEMVKSNRLCERKLFIQFCCRTCLLAG

SEQ ID NO: 59379 - protein, 622 aa, Homo sapiens
MPPRAPPAPGPRPPPRAAAATDTAAGAGGAGGAGGAGGPGFRPLAPRPWRWLLLLALPAACSAPPRPVYTNHWAVQVLGGPAEADRVAAAHGYLNLGQIGNLEDYYHFYHSKTFKRSTLSSRGPHTFLRMDPQVKWLQQQEVKRRVKRQVRSDPQALYFNDPIWSNMWYLHCGDKNSRCRSEMNVQAAWKRGYTGKNVVVTILDDGIERNHPDLAPNYDSYASYDVNGNDYDPSPRYDASNENKHGTRCAGEVAASANNSYCIVGIAYNAKIGGIRMLDGDVTDVVEAKSLGIRPNYIDIYSASWGPDDDGKTVDGPGRLAKQAFEYGIKKGRQGLGSIFVWASGNGGREGDYCSCDGYTNSIYTISVSSATENGYKPWYLEECASTLATTYSSGAFYERKIVTTDLRQRCTDGHTGTSVSAPMVAGIIALALEANSQLTWRDVQHLLVKTSRPAHLKASDWKVNGAGHKVSHFYGFGLVDAEALVVEAKKWTAVPSQHMCVAASDKRPRSIPLVQVLRTTALTSACAEHSDQRVVYLEHVVVRTSISHPRRGDLQIYLVSPSGTKSQLLAKRLLDLSNEGFTNWEFMTVHCWGEKAEGQWTLEIQDLPSQVRNPEKQGNLD

SEQ ID NO: 59380 - protein, 527 aa, Homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMSAEQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 59381 - protein, 559 aa, Homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWIGCWGVGVGSCLWPTWAPTLLSTSGCQETASKASRT

SEQ ID NO: 59382 - protein, 240 aa, Homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 59383 - protein, 526 aa, Homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMLQQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 59384 - protein, 524 aa, Homo sapiens
MYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 59385 - protein, 450 aa, Homo sapiens
MLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMQQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 59386 - protein, 530 aa, Homo sapiens
DGAMYALFLLASLLGAALAGPVLGLKECTRGSAVWCQNVKTASDCGAVKHCLQTVWNKPTVKSLPCDICKDVVTAAGDMLKDNATEEEILVYLEKTCDWLPKPNMSASCKEIVDSYLPVILDIIKGEMSRPGEVCSALNLCESLQKHLAELNHQKQLESNKIPELDMTEVVAPFMANIPLLLYPQDGPRSKPQPKDNGDVCQDCIQMVTDIQTAVRTNSTFVQALVEHVKEECDRLGPGMADICKNYISQYSEIAIQMMMHMSAEQPKEICALVGFCDEVKEMPMQTLVPAKVASKNVIPALELVEPIKKHEVPAKSDVYCEVCEFLVKEVTKLIDNNKTEKEILDAFDKMCSKLPKSLSEECQEVVDTYGSSILSILLEEVSPELVCSMLHLCSGTRLPALTVHVTQPKDGGFCEVCKKLVGYLDRNLEKNSTKQEILAALEKGCSFLPDPYQKQCDQFVAEYEPVLIEILVEVMDPSFVCLKIGACPSAHKPLLGTEKCIWGPSYWCQNTETAAQCNAVEHCKRHVWN

SEQ ID NO: 59387 - protein, 737 aa, Homo sapiens
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKEQKREERRQLKQQLEDMQKQLRQLQEKFYQIYDSTDSENDEDGNLSEDSMRSEILDARAQDSVGRSDNEMCELDPGQFIDRARALIREQEMAENKPKREGNNKERDHGPNSLQPEGKHLAETLKQELNTAMSQVVDTVVKVFSAKPSRQVPQVFPPLQIPQARFAVNGENHNFHTANQRLQCFGDVIIPNPLDTFGNVQMASSTDQTEALPLVVRKNSSDQSASGPAAGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFEVPERFLEVAQITLREFFNAIIAGKDVDPSWKKAIYKVICKLDSEVPEIFKSPNCLQELLHE

SEQ ID NO: 59388 - protein, 676 aa, Homo sapiens
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKEQKREERRQLKQQLEDMQKQLRQLQEKFYQIYDSTDSENDEDGNLSEDSMRSEILDARAQDSVGRSDNEMCELDPGQFIDRARALIREQEMAENKPKREGNNKERDHGPNSLQPEGKHLAETLKQELNTAMSQVVDTVVKVFSAKPSRQVPQVFPPLQIPQARFAVNGENHNFHTANQRLQCFGDVIIPNPLDTFGNVQMASSTDQTEALPLVVRKNSSDQSASGPAAGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFE

SEQ ID NO: 59389 - protein, 737 aa, Homo sapiens; identical to SEQ ID NO: 59387

SEQ ID NO: 59390 - protein, 230 aa, Homo sapiens
MPDHDSTALLSRQTKRRRVDIGVKRTVGTASAFFAKARATFFSAMNPQGSEQDVEYSVVQHADGEKSNVLRKLLKRANSYEDAMMPFPGATIISQLLKNNMNKNGGTEPSFQASGLSSTGSEVHQEDICSNSSRDSPPECLSPFGRPTMSQFDMDRLCDEHLRAKRARVENIIRGMSHSPSVALRGNENEREMAPQSVSPRESYRENKRKQKLPQQQQQSFQQLVSARKE

SEQ ID NO: 59391 - protein, 737 aa, Homo sapiens; identical to SEQ ID NO: 59387

SEQ ID NO: 59392 - protein, 309 aa, Homo sapiens
MASSTDQTEALPLVVRKNSSDQSASGPAAGGHHQPLHQSPLSATTGFTTSTFRHPFPLPLMAYPFQSPLGAPSGSFSGKDRASPESLDLTRDTTSLRTKMSSHHLSHHPCSPAHPPSTAEGLSLSLIKSECGDLQDMSEISPYSGSAMQEGLSPNHLKKAKLMFFYTRYPSSNMLKTYFSDVKFNRCITSQLIKWFSNFREFYYIQMEKYARQAINDGVTSTEELSITRDCELYRALNMHYNKANDFEVPERFLEVAQITLREFFNAIIAGKDVDPSWKKAIYKVICKLDSEVPEIFKSPNCLQELLHE

SEQ ID NO: 59393 - protein, 359 aa, Homo sapiens
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASPQPLEELDHLLLLALMTVLFTMCSLPVIYRAYYGAFKDVKEKNRTSEEAEDLRALRFLSVISIVDPWIFIIFRSPVFRIFFHKIFIRPLRYRSRCSNSTNMESSL

SEQ ID NO: 59394 - protein, 224 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGDWGSTYSVSVVETDYDQYALLYSQGSKGPGEDFRMATLYSRTQTPRAELKEKFTAFCKAQGFTEDTIVFLPQTDKCMTEQ

SEQ ID NO: 59395 - protein, 160 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGGDGCPTSVRGKGQAWA

SEQ ID NO: 59396 - protein, 190 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 59397 - protein, 62 aa, Homo sapiens
  MOD_RES (1)..(1): Any amino acid
XGYHCLPAPNRAQGEVGGDGGSVQFGGSVKTSSALREEQEAQWENWPKSGVLTTAPGFFLGR

SEQ ID NO: 59398 - protein, 213 aa, Homo sapiens
  MOD_RES (1)..(1): Any amino acid
XLRGGGQFLGRGVRGVAARGIGRGGGAGLETGGVDGRGAPAGRRRWVRRVLADAGGGRSPQFLGRWFSAGLASNSSWLREKKAALSMCKSVVAPATDGGLNLTSTFLRKNQCETRTMLLQPAGSLGSYSYRSPHWGSTYSVSVVETDYDQYALLYSQGSKGPGEDFRMATLYSRTQTPRAELKEKFTAFCKAQGFTEDTIVFLPQTDKCMTEQ

SEQ ID NO: 59399 - protein, 195 aa, Homo sapiens
MATHHTLWMGLALLGVLGDLQAAPEAQVSVQPNFQQDKFLGRWFSAGLASNSSWLREKKAALSMCKSVVAPATDGGLNLTSTFLRKNQCETRTMLLQPAGSLGSYSYRSPREWGLHRPPGPSLGATLAGTTLGQPPAAEIHGVGDWGSTYSVSVVETDYDQYALLYSQGSKGPGEDFRMATLYSRTQTPRAELKE

SEQ ID NO: 59400 - protein, 190 aa, Homo sapiens; identical to SEQ ID NO: 59396

SEQ ID NO: 59401 - protein, 402 aa, Homo sapiens
MSPCGPLNLSLAGEATTCAAPWVPNTSAVPPSGASPALPIFSMTLGAVSNLLALALLAQAAGRLRRRRSAATFLLFVASLLATDLAGHVIPGALVLRLYTAGRAPAGGACHFLGGCMVFFGLCPLLLGCGMAVERCVGVTRPLLHAARVSVARARLALAAVAAVALAVALLPLARVGRYELQYPGTWCFIGLGPPGGWRQALLAGLFASLGLVALLAALVCNTLSGLALLRARWRRRSRRPPPASGPDSRRRWGAHGPRSASASSASSIASASTFFGGSRSSGSARRARAHDVEMVGQLVGIMVVSCICWSPMLVLVALAVGGWSSTSLQRPLFLAVRLASWNQILDPWVYILLRQAVLRQLLRLLPPRAGAKGGPAGLGLTPSAWEASSLRSSRHSGLSHF

SEQ ID NO: 59402 - protein, 358 aa, Homo sapiens
MGNASNDSQSEDCETRQWLPPGESPAISSVMFSAGVLGNLIALALLARRWRGDVGCSAGRRSSLSLFHVLVTELVFTDLLGTCLISPVVLASYARNQTLVALAPESRACTYFAFAMTFFSLATMLMLFAMALERYLSIGHPYFYQRRVSRSGGLAVLPVIYAVSLLFCSLPLLDYGQYVQYCPGTWCFIRHGRTAYLQLYATLLLLLIVSVLACNFSVILNLIRMHRRSRRSRCGPSLGSGRGGPGARRRGERVSMAEETDHLILLAIMTITFAVCSLPFTIFAYMNETSSRKEKWDLQALRFLSINSIIDPWVFAILRPPVLRLMRSVLCCRISLRTQDATQTSCSTQSDASKQADL

SEQ ID NO: 59403 - protein, 390 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQIRYHTNNYASSSTSLPCQCSSTLMWSDHLER

SEQ ID NO: 59404 - protein, 419 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQVANAVSSCSNDGQKGQPISLSNEIIQTEAIRYHTNNYASSSTSLPCQCSSTLMWSDHLER

SEQ ID NO: 59405 - protein, 429 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQFWRPASSGSGCQQIRCLMESCSLTQTGVQWSDFRSLQPSPPPLTAIFASWVQVILLPQPPK

SEQ ID NO: 59406 - protein, 418 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQLICSLQNSQIQRATAHCGQVQTYRVLNREEMEVLVSSINVYTRISTVKTE

SEQ ID NO: 59407 - protein, 402 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEMGPDGRCFCHAWRQVPRTWCSSHDREPCSVQLS

SEQ ID NO: 59408 - protein, 388 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQVANAVSSCSNDGQKGQPISLSNEIIQTEA

SEQ ID NO: 59409 - protein, 390 aa, Homo sapiens; identical to SEQ ID NO: 59403

SEQ ID NO: 59410 - protein, 365 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQEEFWGN

SEQ ID NO: 59411 - protein, 454 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQVANAVSSCSNDGQKGQPISLSNEIIQTEAMRKRRLREQAPLLPTSTVIDPSRFCAQPFRWFLDLSFPAMSSSHPQLPLTLASFKLLREPCSVQLS

SEQ ID NO: 59412 - protein, 390 aa, Homo sapiens; identical to SEQ ID NO: 59403

SEQ ID NO: 59413 - protein, 374 aa, Homo sapiens
MKETRGYGGDAPFCTRLNHSYTGMWAPERSAEARGNLTRPPGSGEDCGSVSVAFPITMLLTGFVGNALAMLLVSRSYRRRESKRKKSFLLCIGWLALTDLVGQLLTTPVVIVVYLSKQRWEHIDPSGRLCTFFGLTMTVFGLSSLFIASAMAVERALAIRAPHWYASHMKTRATRAVLLGVWLAVLAFALLPVLGVGQYTVQWPGTWCFISTGRGGNGTSSSHNWGNLFFASAFAFLGLLALTVTFSCNLATIKALVSRCRAKATASQSSAQWGRITTETAIQLMGIMCVLSVCWSPLLIMMLKMIFNQTSVEHCKTHTEKQKECNFFLIAVRLASLNQILDPWVYLLLRKILLRKFCQMRKRRLREQEEFWGN

SEQ ID NO: 59414 - protein, 488 aa, Homo sapiens
MSTPGVNSSASLSPDRLNSPVTIPAVMFIFGVVGNLVAIVVLCKSRKEQKETTFYTLVCGLAVTDLLGTLLVSPVTIATYMKGQWPGGQPLCEYSTFILLFFSLSGLSIICAMSVERYLAINHAYFYSHYVDKRLAGLTLFAVYASNVLFCALPNMGLGSSRLQYPDTWCFIDWTTNVTAHAAYSYMYAGFSSFLILATVLCNVLVCGALLRMHRQFMRRTSLGTEQHHAAAAASVASRGHPAASPALPRLSDFRRRRSFRRIAGAEIQMVILLIATSLVVLICSIPLVVRVFVNQLYQPSLEREVSKNPDLQAIRIASVNPILDPWIYILLRKTVLSKAIEKIKCLFCRIGGSRRERSGQHCSDSQRTSSAMSGHSRSFISRELKEISSTSQTLLPDLSLPDLSENGLGGRNLLPGVPGMGLAQEDTTSLRTLRISETSDSSQGQDSESVLLVDEAGGSGRAGPAPKGSSLQVTFPSETLNLSEKCI

SEQ ID NO: 59415 - protein, 152 aa, Homo sapiens
MPAHSLVMSSPALPAFLLCSTLLVIKMYVVAIITGQVRLRKKAFANPEDALRHGGPQYCRSDPDVERCLRAHRNDMETIYPFLFLGFVYSFLGPNPFVAWMHFLVFLVGRVAHTVAYLGKLRAPIRSVTYTLAQLPCASMALQILWEAARHL

SEQ ID NO: 59416 - protein, 186 aa, Homo sapiens
MKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 59417 - protein, 377 aa, Homo sapiens
MDPAARVVRALWPGGCALAWRLGGRPQPLLPTQSRAGFAGAAGGPSPVAAARKGSPRLLGAAALALGGALGLYHTARWHLRAQDLHAERSAAQLSLSSRLQLTLYQYKTCPFCSKVRAFLDFHALPYQVVEVNPVRRAEIKFSSYRKVPILVAQEGESSQQLNDSSVIISALKTYLVSGQPLEEIITYYPAMKAVNEQGKEVTEFGNKYWLMLNEKEAQQVYGGKEARTEEMKWRQWADDWLVHLISPNVYRTPTEALASFDYIVREGKFGAVEGAVAKYMGAAAMYLISKRLKSRHRLQDNVREDLYEAADKWVAAVGKDRPFMGGQKPNLADLAVYGVLRVMEGLDAFDDLMQHTHIQPWYLRVERAITEASPAH

SEQ ID NO: 59418 - protein, 297 aa, Homo sapiens
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLGYRIILNGKEKYKVYEEQSDFLHRLQWPTLE

SEQ ID NO: 59419 - protein, 359 aa, Homo sapiens
MSMNNSKQLVSPAAALLSNTTCQTENRLSVFFSVIFMTVGILSNSLAIAILMKAYQRFRQKSKASFLLLASGLVITDFFGHLINGAIAVFVYASDKEWIRFDQSNVLCSIFGICMVFSGLCPLLLGSVMAIERCIGVTKPIFHSTKITSKHVKMMLSGVCLFAVFIALLPILGHRDYKIQASRTWCFYNTEDIKDWEDRFYLLLFSFLGLLALGVSLLCNAITGITLLRVKFKSQQHRQGRSHHLEMVIQLLAIMCVSCICWSPFLVTMANIGINGNHSLETCETTLFALRMATWNQILDPWVYILLRKAVLKNLYKLASQCCGVHVISLHIWELSSIKNSLKVAAISESPVAEKSAST

SEQ ID NO: 59420 - protein, 359 aa, Homo sapiens; identical to SEQ ID NO: 59419

SEQ ID NO: 59421 - protein, 879 aa, Homo sapiens
MGRLASRPLLLALLSLALCRGRVVRVPTATLVRVVGTELVIPCNVSDYDGPSEQNFDWSFSSLGSSFVELASTWEVGFPAQLYQERLQRGEILLRRTANDAVELHIKNVQPSDQGHYKCSTPSTDATVQGNYEDTVQVKVLADSLHVGPSARPPPSLSLREGEPFELRCTAASASPLHTHLALLWEVHRGPARRSVLALTHEGRFHPGLGYEQRYHSGDVRLDTVGSDAYRLSVSRALSADQGSYRCIVSEWIAEQGNWQEIQEKAVEVATVVIQPSVLRAAVPKNVSVAEGKELDLTCNITTDRADDVRPEVTWSFSRMPDSTLPGSRVLARLDRDSLVHSSPHVALSHVDARSYHLLVRDVSKENSGYYYCHVSLWAPGHNRSWHKVAEAVSSPAGVGVTWLEPDYQVYLNASKVPGFADDPTELACRVVDTKSGEANVRFTVSWYYRMNRRSDNVVTSELLAVMDGDWTLKYGERSKQRAQDGDFIFSKEHTDTFNFRIQRTTEEDRGNYYCVVSAWTKQRNNSWVKSKDVFSKPVNIFWALEDSVLVVKARQPKPFFAAGNTFEMTCKVSSKNIKSPRYSVLIMAEKPVGDLSSPNETKYIISLDQDSVVKLENWTDASRVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPDDMAFDVSWFAVHSFGLDKAPVLLSSLDRKGIVTTSRRDWKSDLSLERVSVLEFLLQVHGSEDQDFGNYYCSVTPWVKSPTGSWQKEAEIHSKPVFITVKMDVLNAFKYPLLIGVGLSTVIGLLSCLIGYCSSHWCCKKEVQETRRERRRLMSMEMD

SEQ ID NO: 59422 - protein, 738 aa, Homo sapiens
SGAAGAGRGGGGEAAGKEEEGEPFELRCTAASASPLHTHLALLWEVHRGPARRSVLALTHEGRFHPGLGYEQRYHSGDVRLDTVGSDAYRLSVSRALSADQGSYRCIVSEWIAEQGNWQEIQEKAVEVATVVIQPSVLRAAVPKNVSVAEGKELDLTCNITTDRADDVRPEVTWSFSRMPDSTLPGSRVLARLDRDSLVHSSPHVALSHVDARSYHLLVRDVSKENSGYYYCHVSLWAPGHNRSWHKVAEAVSSPAGVGVTWLEPDYQVYLNASKVPGFADDPTELACRVVDTKSGEANVRFTVSWYYRMNRRSDNVVTSELLAVMDGDWTLKYGERSKQRAQDGDFIFSKEHTDTFNFRIQRTTEEDRGNYYCVVSAWTKQRNNSWVKSKDVFSKPVNIFWALEDSVLVVKARQPKPFFAAGNTFEMTCKVSSKNIKSPRYSVLIMAEKPVGDLSSPNETKYIISLDQDSVVKLENWTDASRVDGVVLEKVQEDEFRYRMYQTQVSDAGLYRCMVTAWSPVRGSLWREAATSLSNPIEIDFQTSGPIFNASVHSDTPSVIRGDLIKLFCIITVEGAALDPDDMAFDVSWFAVHSFGLDKAPVLLSSLDRKGIVTTSRRDWKSDLSLERVSVLEFLLQVHGSEDQDFGNYYCSVTPWVKSPTGSWQKEAEIHSKPVFITVKMDVLNAFKYPLLIGVGLSTVIGLLSCLIGYCSSHWCCKKEVQETRRERRRLMSMEMD

SEQ ID NO: 59423 - protein, 386 aa, Homo sapiens [sequence omitted]

SEQ ID NO: 59424 - protein, 500 aa, Homo sapiens
MAWAALLGLLAALLLLLLLSRRRTRRPGEPPLDLGSIPWLGYALDFGKDAASFLTRMKEKHGDIFTILVGGRYVTVLLDPHSYDAVVWEPRTRLDFHAYAIFLMERIFDVQLPHYSPSDEKARMKLTLLHRELQALTEAMYTNLHAVLLGDATEAGSGWHEMGLLDFSYSFLLRAGYLTLYGIEALPRTHESQAQDRVHSADVFHTFRQLDRLLPKLARGSLSVGDKDHMCSVKSRLWKLLSPARLARRAHRSKWLESYLLHLEEMGVSEEMQARALVLQLWATQGNMGPAAFWLLLFLLKNPEALAAVRGELESILWQAEQPVSQTTTLPQKVLDSTPVLDSVLSESLRLTAAPFITREVVVDLAMPMADGREFNLRRGDRLLLFPFLSPQRDPEIYTDPEVFKYNRFLNPDGSEKKDFYKDGKRLKNYNMPWGAGHNHCLGRSYAVNSIKQFVFLVLVHLDLELINADVEIPEFDLSRYGFGLMQPEHDVPVRYRIRP

SEQ ID NO: 59425 - protein, 135 aa, Homo sapiens
MRAFLRNQKYEDMHNIIHILQIRKLRHRLSNFPRLPGILAPETVLLPFCYKVFRKKEKVKRSQKATEFIDYSIEQSHHAILTPLQTHLTMKGSSMKCSSLSSEAILFTLTLQLTQTLGLECCLLYLSKTIHPQII

SEQ ID NO: 59426 - protein, 114 aa, Homo sapiens
MAGLALQPGTALLCYSCKAQVSNEDCLQVENCTQLGEQCWTARIRAVGLLTVISKGCSLNCVDDSQDYYVGKKNITCCDTDLCNASGAHALQPAAAILALLPALGLLLWGPGQL

SEQ ID NO: 59427 - protein, 237 aa, Homo sapiens
MMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 59428 - protein, 287 aa, Homo sapiens
MHRLMGVNSTAAAAAGQPNVSCTCNCKRSLFQSMEITELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 59429 - protein, 252 aa, Homo sapiens
MAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVIGHYPGSSFQHQQSSGPPSLLEGTRLHHTHIAPLESAAIWSKEKDKQKGHPL

SEQ ID NO: 59430 - protein, 237 aa, Homo sapiens; identical to SEQ ID NO: 59427

SEQ ID NO: 59431 - protein, 237 aa, Homo sapiens; identical to SEQ ID NO: 59427

SEQ ID NO: 59432 - protein, 227 aa, Homo sapiens
MHRLMGVNSTAAAAAGQPNVSCTCNCKRSLFQSMEISCHGFPVCKSHQHQEWKSLCWSLRSPGGASSITGFGSMKVTNPAMNLPECQWLRIQKAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLR

SEQ ID NO: 59433 - protein, 208 aa, Homo sapiens
MPAIPAHGAELEFVQIIIIVVVMMVMVVVITCLLSHYKLSARSFISRHSQGRRREDALSSEGCLWPSESTVSGNGIPEPQVYAPPRPTDRLAVPPFAQRERFHRFQPTYPYLQHEIDLPPTISLSDGEEPPPYQGPCTLQLRDPEQQLELNRESVRAPPNRTIFDSDLMDSARLGGPCPPSSNSGISATCYGSGGRMEGPPPTYSEVI

SEQ ID NO: 59434 - protein, 51 aa, Homo sapiens
MARYRCCRSQSRSRYYRQRQRSRRRRRRSCQTRRRAMRCCRPRYRPRCRRH

SEQ ID NO: 59435 - protein, 102 aa, Homo sapiens
MVRYRVRSLSERSHEVYRQQLHGQEQGHHGQEEQGLSPEHVEVYERTHGQSHYRRRHCSRRRLHRIHRRQHRSCRRRKRRSCRHRRRHRRGCRTRKRTCRRH

SEQ ID NO: 59436 - protein, 140 aa, Homo sapiens
MVRYRVRSLSERSHEVYRQQLHGQEQGHHGQEEQGLSPEHVEVYERTHGQSHYRRRHCSRRRLHRIHRRQHRSCRRRKRRSCRHRRRHRRESLGDPLNQNFLSQKAAEPGREHAEGTKLPGPLTPSWKLRKSRPKHQVRP

SEQ ID NO: 59437 - protein, 218 aa, Homo sapiens
  MOD_RES (1)..(1): Any amino acid
XLALLLARAGLRKPESQEAAPLSGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEGSSGRHHKQLYVQPPLPQVQFPQGHLWRHGLCWQCPRREGCLLR

SEQ ID NO: 59438 - protein, 247 aa, Homo sapiens
MNPLLILTFVAAALAAPFDDDDKIVGGYNCEENSVPYQVSLNSGYHFCGGSLINEQWVVSAGHCYKSRIQVRLGEHNIEVLEGNEQFINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 59439 - protein, 237 aa, Homo sapiens
MNPLLILTFVAAALAAPFDDDDKIVGGYNCEENSVPYQVSLNSGYHFCGGSLINEQWVVSAGHCYKSRIQVRLGEHNINAAKIIRHPQYDRKTLNNDIMLIKLSSRAVINARVSTISLPTAPPATGTKCLISGWGNTASSGADYPDELQCLDAPVLSQAKCEASYPGKITSNMFCVGFLEGGKDSCQGDSGGPVVCNGQLQGVVSWGDGCAQKNKPGVYTKVYNYVKWIKNTIAANS

SEQ ID NO: 59440 - protein, 875 aa, Homo sapiens
MTLARFVLALMLGALPEVVGFDSVLNDSLHHSHRHSPPAGPHYPYYLPTQQRPPRTRPPPPLPRFPRPPRALPAQRPHALQAGHTPRPHPWGCPAGEPWVSVTDFGAPCLRWAEVPPFLERSPPASWAQLRGQRHNFCRSPDGAGRPWCFYGDARGKVDWGYCDCRHGSVRLRGGKNEFEGTVEVYASGVWGTVCSSHWDDSDASVICHQLQLGGKGIAKQTPFSGLGLIPIYWSNVRCRGDEENILLCEKDIWQGGVCPQKMAAAVTCSFSHGPTFPIIRLAGGSSVHEGRVELYHAGQWGTVCDDQWDDADAEVICRQLGLSGIAKAWHQAYFGEGSGPVMLDEVRCTGNELSIEQCPKSSWGEHNCGHKEDAGVSCTPLTDGVIRLAGGKGSHEGRLEVYYRGQWGTVCDDGWTELNTYVVCRQLGFKYGKQASANHFEESTGPIWLDDVSCSGKETRFLQCSRRQWGRHDCSHREDVSIACYPGGEGHRLSLGFPVRLMDGENKKEGRVEVFINGQWGTICDDGWTDKDAAVICRQLGYKGPARARTMAYFGEGKGPIHVDNVKCTGNERSLADCIKQDIGRHNCRHSEDAGVICDYFGKKASGNSNKESLSSVCGLRLLHRRQKRIIGGKNSLRGGWPWQVSLRLKSSHGDGRLLCGATLLSSCWVLTAAHCFKRYGNSTRSYAVRVGDYHTLVPEEFEEEIGVQQIVIHREYRPDRSDYDIALVRLQGPEEQCARFSSHVLPACLPLWRERPQKTASNCYITGWGDTGRAYSRTLQQAAIPLLPKRFCEERYKGRFTGRMLCAGNLHEHKRVDSCQGDSGGPLMCERPGESWVVYGVTSWGYGCGVKDSPGVYTKVSAFVPWIKSVTKL

SEQ ID NO: 59441 - protein, 514 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDVVSRSLMSTAIGGSLECRAAVSVAFAEVERRLRSGGAAQAALRTELSACGPLGRAENQAELLGALQALVGGVVQYDGQTGAPLSVRQLCGLLLGGGGNRSHSTPYCGLRRAVQIVLHSLGQKCLSFSRAETVAQLRSTEPQLSGVGDRQWLYQTCTEFGFYVTCENPRCPFSQLPALPSQLDLCEQVFGLSALSVAQAVAQTNSYYGGQTPGANKVLFVNGDTDPWHVLSVTQALGSSESTLLIRTGSHCLDMAPERPSDSPSLRLGRQNIFQQLQTWLKLAKESQIKGEV

SEQ ID NO: 59442 - protein, 273 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDIVLHSLGQKCLSFSRAETVAQLRSTEPQLSGVGDRQWLYQTCTEFGFYIT

SEQ ID NO: 59443 - protein, 166 aa, Homo sapiens
MAVWLAQWLGPLLLVSLWGLLAPASLLRRLGEHIQQFQESSAQGLGLSLGPGAAALPKVGWLEQLLDPFNVSDRRSFLQRYWVNDQHWVGQDGPIFLHLGGEGSLGPGSVMRGHPAALAPAWGALVISLEHRFYGLSIPAGGLEMAQLRFLSSRLALSCTAWARSV

SEQ ID NO: 59444 - protein, 165 aa, Homo sapiens
  MOD_RES (1)..(1): Any amino acid
XVMRGHPAALAPAWGALVISLEHRFYGLSIPAGGLEMAQLRFLSSRLALADVVSARLALSRLFNISSSSPWICFGGSYAGSLAAWARLKFPHLIFASVASSAPVRAVLDFSEYNDIVLHSLGQKCLSFSRAETVAQLRSTEPQLSGVGDRQWLYQTCTEFGFYVT

SEQ ID NO: 59445 - protein, 314 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 59446 - protein, 300 aa, Homo sapiens
MGARGALLLALLLARAGLRKPESQEAAPLSGPCGRRVITSRIVGGEDAELGRWPWQGSLRLWDSHVCGVSLLSHRWALTAAHCFETYSDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMGDSGGPLACNKNGLWYQIGVVSWGVGCGRPNRPGVYTNISHHFEWIQKLMAQSGMSQPDPSWPLLFFPLLWALPLLGPV

SEQ ID NO: 59447 - protein, 312 aa, Homo sapiens
MGARGALLLALLLARAGLRKPESQEAAPLSGPCGRRVITSRIVGGEDAELGRWPWQGSLRLWDSHVCGVSLLSHRWALTAAHCFETDLSDPSGWMVQFGQLTSMPSFWSLQAYYTRYFVSNIYLSPRYLGNSPYDIALVKLSAPVTYTKHIQPICLQASTFEFENRTDCWVTGWGYIKEDEALPSPHTLQEVQVAIINNSMCNHLFLKYSFRKDIFGDMVCAGNAQGGKDACFGDSGGPLACNKNGLWYQIGVVSWGVGCGRPNRPGVYTNISHHFEWIQKLMAQSGMSQPDPSWPLLFFPLLWALPLLGPV

SEQ ID NO: 59448 - protein, 317 aa, Homo sapiens
MVVSGAPPALGGGCLGTFTSLLLLASTAILNAARIPVPPACGKPQQLNRVVGGEDSTDSEWPWIVSIQKNGTHHCAGSLLTSRWVITAAHCFKDNLNKPYLFSVLLGAWQLGNPGSRSQKVGVAWVEPHPVYSWKEGACADIALVRLERSIQFSERVLPICLPDASIHLPPNTHCWISGWGSIQDGVPLPHPQTLQKLKVPIIDSEVCSHLYWRGAGQGPITEDMLCAGYLEGERDACLGDSGGPLMCQVDGAWLLAGIISWGEGCAERNRPGVYISLSAHRSWVEKIVQGVQLRGRAQGGGALRAPSQGSGAAARS

SEQ ID NO: 59449 - protein, 261 aa, Homo sapiens
MHMRETSGFTLKKGRSAPLVFHPPDALIAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 59450 - protein, 304 aa, Homo sapiens
MCGPDDRCPARWPGPGRAVKCGKGLAAARPGRVERGGAQRGGAGLELHPLLGGRTWRAARDADGCEALGTVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 59451 - protein, 247 aa, Homo sapiens
MNPFLILAFVGAAVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 59452 - protein, 240 aa, Homo sapiens
MGPAGEVAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVLTQAECKASYPGKITNSMFCVGFLEGGKDSCQRDSGGPVVCNGQLQGVVSWGHGCAWKNRPGVYTKVYNYVDWIKDTIAANS

SEQ ID NO: 59453 - protein, 178 aa, Homo sapiens
MRETSGFTLKKGRSAPLVFHPPDALIAVPFDDDDKIVGGYTCEENSLPYQVSLNSGSHFCGGSLISEQWVVSAAHCYKTRIQVRLGEHNIKVLEGNEQFINAAKIIRHPKYNRDTLDNDIMLIKLSSPAVINARVSTISLPTTPPAAGTECLISGWGNTLSFGADYPDELKCLDAPVL

SEQ ID NO: 59454 - protein, 280 aa, Homo sapiens
MRGVSCLQVLLLLVLGAAGTQGRKSAACGQPRMSSRIVGGRDGRDGEWPWQASIQHRGAHVCGGSLIAPQWVLTAAHCFPRRALPAEYRVRLGALRLGSTSPRTLSVPVRRVLLPPDYSEDGARGDLALLQLRRPVPLSARVQPVCLPVPGARPPPGTPCRVTGWGSLRPGVPLPEWRPLQGVRVPLLDSRTCDGLYHVGADVPQAERIVLPGSLCAGYPQGHKDACQGDSGGPLTCLQSGSWVLVGVVSWGKGCALPNRPGVYTSVATYSPWIQARVSF

SEQ ID NO: 59455 - protein, 343 aa, Homo sapiens
MAQKGVLGPGQLGAVAILLYLGLLRSGTGAEGAEAPCGVAPQARITGGSSAVAGQWPWQVSITYEGVHVCGGSLVSEQWVLSAAHCFPSEHHKEAYEVKLGAHQLDSYSEDAKVSTLKDIIPHPSYLQEGSQGDIALLQLSRPITFSRYIRPICLPAANASFPNGLHCTVTGWGHVAPSVSLLTPKPLQQLEVPLISRETCNCLYNIDAKPEEPHFVQEDMVCAGYVEGGKDACQGDSGGPLSCPVEGLWYLTGIVSWGDACGARNRPGVYTLASSYASWIQSKVTELQPRVVPQTQESQPDSNLCGSHLAFSSAPAQGLLRPILFLPLGLALGLLSPWLSEH

SEQ ID NO: 59456 - protein, 167 aa, Homo sapiens
MAQKGVLGPGQLGAVAILLYLGLLRSGTGKEGAAAPCGVAPQARITGGSSAVAGQWPWQVSITFSRYIRPICLPAANASFPNGLHCTVTGWGHVAPSVSLLTPKPLQQLEVPLISRETCNCLYNIDAKPEEPHFVQEDMVCAGYVEGALLRVTLGAHSPALWRVSGT

SEQ ID NO: 59457 - protein, 398 aa, Homo sapiens
MELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMDEIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 59458 - protein, 254 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 59459 - protein, 440 aa, Homo sapiens
MGQSQSGGHGPGGGKKDDKDKKKKYEPPVPTRVGKKKKKTKGPDAASKLPLVTPHTQCRLKLLKLERIKDYLLMEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 59460 - protein, 367 aa, Homo sapiens
MEEEFIRNQEQMKPLEEKQEEERSKVDDLRGTPMSVGTLEEIIDDNHAIVSTSVGSEHYVSILSFVDKDLLEPGCSVLLNHKVHAVIGVLMDDTDPLVTVMKVEKAPQETYADIGGLDNQIQEIKESVELPLTHPEYYEEMGIKPPKGVILYGPPGTGKTLLAKAVANQTSATFLRVVGSELIQKYLGDGPKLVRELFRVAEEHAPSIVFIDEIDAIGTKRYDSNSGGEREIQRTMLELLNQLDGFDSRGDVKVIMATNRIETLDPALIRPGRIDRKIEFPLPDEKTKKRIFQIHTSRMTLADDVTLDDLIMAKDDLSGADIKAICTEAGLMALRERRMKVTNEDFKKSKENVLYKKQEGTPEGLYL

SEQ ID NO: 59461 - protein, 433 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVAPTDIEEGMRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 59462 - protein, 130 aa, Homo sapiens
MPDYLGADQRKTKEDEKDDKPIRALDEGDIALLKTYGQSTYSRQIKQVEDDIQQLLKKINELTGIKESDTGLAPPALWDLAADKQTLQSEQPLQVARCTKIINADSEDPKYIINVKQFAKFVVDLSDQVA

SEQ ID NO: 59463 - protein, 433 aa, Homo sapiens; identical to SEQ ID NO: 59461

SEQ ID NO: 59464 - protein, 130 aa, Homo sapiens; identical to SEQ ID NO: 59462

SEQ ID NO: 59465 - protein, 296 aa, Homo sapiens
MRVGVDRNKYQIHIPLPPKIDPTVTMMQVEEKPDVTYSDVGGCKEQIEKLREVVETPLLHPERFVNLGIEPPKGVLLFGPPGTGKTLCARAVANRTDACFIRVIGSELVQKYVGEGARMVRELFEMARTKKACLIFFDEIDAIGGARFDDGAGGDNEVQRTMLELINQLDGFDPRGNIKVLMATNRPDTLDPALMRPGRLDRKIEFSLPDLEGRTHIFKIHARSMSVERDIRFELLARLCPNSTGAEIRSVCTEAGMFAIRARRKIATEKDFLEAVNKVIKSYAKFSATPRYMTYN

SEQ ID NO: 59466 - protein, 439 aa, Homo sapiens
MNLLPNIESPVTRQEKMATVWDEAEQDGIGEEVLKMSTEEIIQRTRLLDSEIKIMKSEVLRVTHELQAMKDKIKENSEKIKVNKTLPYLVSNVIELLDVDPNDQEEDGANIDLDSQRKGKCAVIKTSTRQTYFLPVIGLVDAEKLKPGDLVGVNKDSYLILETLPTEYDSRVKAMEVDERPTEQYSDIGGLDKQIQELVEAIVLPMNHKEKFENLGIQPPKGVLMYGPPGTGKTLLARACAAQTKATFLKLAGPQLVQMFIGDGAKLVRDAFALAKEKAPSIIFIDELDAIGTKRFDSEKAGDREVQRTMLELLNQLDGFQPNTQVKVIAATNRVDILDPALLRSGRLDRKIEFPMPNEEARARIMQIHSRKMNVSPDVNYEELARCTDDFNGAQCKAVCVEAGMIALRRGATELTHEDYMEGILEVQAKKKANLQYYA

SEQ ID NO: 59467 - protein, 418 aa, Homo sapiens
MEEIGILVEKAQDEIPALSVSRPQTGLSFLGPEPEDLEDLYSRYKKLQQELEFLEVQEEYIKDEQKNLKKEFLHAQEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 59468 - protein, 387 aa, Homo sapiens
MEEIGILVEKAQDEIPALSVSRPQTGLSFLGPEPEDLEDLYSRYKEEVKRIQSIPLVIGQFLEAVDQNTAIVGSTTGSNYYVRILSTIDRELLKPNASVALHKHSNALVDVLPPEADSSIMMLTSDQKPDVMYADIGGMDIQKQEVREAVELPLTHFELYKQIGIDPPRGVLMYGPPGCGKTMLAKAVAHHTTAAFIRVVGSEFVQKYLGEGPRMVRDVFRLAKENAPAIIFIDEIDAIATKRFDAQTGADREVQRILLELLNQMDGFDQNVNVKVIMATNRADTLDPALLRPGRLDRKIEFPLPDRRQKRLIFSTITSKMNLSEEVDLEDYVARPDKISGADINSICQESGMLAVRENRYIVLAKDFEKAYKTVIKKDEQEHEFYK

SEQ ID NO: 59469 - protein, 406 aa, Homo sapiens
MALDGPEQMELEEGKAGSGLRQYYLSKIEELQLIVNDKSQNLRRLQAQRNELNAKVRLLREELQLLQEQGSYVGEVVRAMDKKKVLVKVHPEGKFVVDVDKNIDINDVTPNCRVALRNDSYTLHKILPNKVDPLVSLMMVEKVPDSTYEMIGGLDKQIKEIKEVIELPVKHPELFEALGIAQPKGVLLYGPPGTGKTLLARAVAHHTDCTFIRVSGSELVQKFIGEGARMVRELFVMAREHAPSIIFMDEIDSIGSSRLEGGSGGDSEVQRTMLELLNQLDGFEATKNIKVIMATNRIDILDSALLRPGRIDRKIEFPPPNEEARLDILKIHSRKMNLTRGINLRKIAELMPGASGAEVKGVCTEAGMYALRERRVHVTQEDFEMAVAKVMQKDSEKNMSIKKLWK

SEQ ID NO: 59470 - protein, 398 aa, Homo sapiens; identical to SEQ ID NO: 59457

SEQ ID NO: 59471 - protein, 403 aa, Homo sapiens
MAIPGIPYERRLLIMADPRDKALQDYRKKLLEHKEIDGRLKELREQLKELTKQYEKSENDLKALQSVGQIVGEVLKQLTEEKFIVKATNGPRYVVGCRRQLDKSKLKPGTRVALDMTTLTIMRYLPREVDPLVYNMSHEDPGNVSYSEIGGLSEQIRELREVIELPLTNPELFQRVGIIPPKGCLLYGPPGTGKTLLARAVASQLDCNFLKVVSSSIVDKYIGESARLIREMFNYARDHQPCIIFMDEIDAIGGRRFSEGTSADREIQRTLMELLNQMDGFDTLHRVKMIMATNRPDTLDPALLRPGRLDRKIHIDLPNEQARLDILKIHAGPITKHGEIDYEAIVKLSDGFNGADLRNVCTEAGMFAIRADHDFVVQEDFMKAVRKVADSKKLESKLDYKPV

SEQ ID NO: 59472 - protein, 310 aa, Homo sapiens
MDRLLRLGGGMPGLGQGPPTDAPAVDTAEQVYISSLALLKMLKHGRAGVPMEVMGLMLGEFVDDYTVRVIDVFAMPQSGTGVSVEAVDPVFQAKMLDMLKQTGRPEMVVGWYHSHPGFGCWLSGVDINTQQSFEALSERAVAVVVDPIQSVKGKVVIDAFRLINANMMVLGHEPRQTTSNLGHLNKPSIQALIHGLNRHYYSITINYRKNELEQKMLLNLHKKSWMEGLTLQDYSEHCKHNESVVKEMLELAKNYNKAVEEEDKMTPEQLAIKNVGKQDPKRHLEEHVDVLMTSNIVQCLAAMLDTVVFK

SEQ ID NO: 59473 - protein, 84 aa, Homo sapiens
MDRLLRLGGGMPGLGQGPPTDAPAVDTAEQVYISSLALLKMLKHGRAGVPMEVMGLMLGEFVDDYTVRVIDVFAMPQSGTGVSV

SEQ ID NO: 59474 - protein, 908 aa, Homo sapiens
MEEGGRDKAPVQPQQSPAAAPGGTDEKPSGKERRDAGDKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 59475 - protein, 580 aa, Homo sapiens
QCTAQQQLLGLSSGAGHHGAQLMLQNPPREQQVWGQWLSGGLCPHEPGLLFCEWLCECSFWDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGPLLLWGRRLVQRWHYEPYHQLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVFGRTPIMISK

SEQ ID NO: 59476 - protein, 900 aa, Homo sapiens
MEEGGRDKAPVQPQQSPAAAPGGTDEKPSGKDKEQELSEEDKQLQDELEMLVERLGEKDTSLYRPALEELRRQIRSSTTSMTSVPKPLKFLRPHYGKLKEIYENMAPGENKRFAADIISVLAMTMSGERECLKYRLVGSQEELASWGHEYVRHLAGEVAKEWQELDDAEKVQREPLLTLVKEIVPYNMAHNAEHEACDLLMEIEQVDMLEKDIDENAYAKVCLYLTSCVNYVPEPENSALLRCALGVFRKFSRFPEALRLALMLNDMELVEDIFTSCKDVVVQKQMAFMLGRHGVFLELSEDVEEYEDLTEIMSNVQLNSNFLALARELDIMEPKVPDDIYKTHLENNRFGGSGSQVDSARMNLASSFVNGFVNAAFGQDKLLTDDGNKWLYKNKDHGMLSAAASLGMILLWDVDGGLTQIDKYLYSSEDYIKSGALLACGIVNSGVRNECDPALALLSDYVLHNSNTMRLGSIFGLGLAYAGSNREDVLTLLLPVMGDSKSSMEVAGVTALACGMIAVGSCNGDVTSTILQTIMEKSETELKDTYARWLPLGLGLNHLGKGEAIEAILAALEVVSEPFRSFANTLVDVCAYAGSGNVLKVQQLLHICSEHFDSKEKEEDKDKKEKKDKDKKEAPADMGAHQGVAVLGIALIAMGEEIGAEMALRTFGHLLRYGEPTLRRAVPLALALISVSNPRLNILDTLSKFSHDADPEVSYNSIFAMGMVGSGTNNARLAAMLRQLAQYHAKDPNNLFMVRLAQGLTHLGKGTLTLCPYHSDRQLMSQVAVAGLLTVLVSFLDVRNIILGKSHYVLYGLVAAMQPRMLVTFDEELRPLPVSVRVGQAVDVVGQAGKPKTITGFQTHTTPVLLAHGERAELATEEFLPVTPILEGFVILRKNPNYDL

SEQ ID NO: 59477 - protein, 504 aa, Homo sapiens
MAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKAAIKSLSRISLTQAGLEALFESNLLDDLKSVMKTNDIVRYRVYELIIEISSVSPESLNYCTTSGLVTQLLRELTGEDVLVRATCIEMVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGTRFERLLMRIGHQSKNAPVELKIRCLDAISSLLYLPPEQQTDDLLRMTESWFSSLSRDPLELFRGISSQPFPELHCAALKVFTAIANQPWAQKLMFNSPGFVEYVVDRSVEHDKASKDAKYELVKALANSKTIAEIFGNPNYLRLRTYLSEGPYYVKPVSTTAVEGAE

SEQ ID NO: 59478 - protein, 157 aa, Homo sapiens
MVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGWYDLALFRDILIFDRGSICKFICWWVNYIVETILWVAVLLTMTLYSCLKI

SEQ ID NO: 59479 - protein, 461 aa, Homo sapiens
MAAQALALLREVARLEAPLEELRALHSVLQAVPLNELRQQAAELRLGPLFSLLNENHREKTTLCVSILERLLQAMEPVHVARNLRVDLQRGLIHPDDSVKILTLSQIGRIVENSDAVTEILNNAELLKQIVYCIGGENLSVAKALIIEISSVSPESLNYCTTSGLVTQLLRELTGEDVLVRATCIEMVTSLAYTHHGRQYLAQEGVIDQISNIIVGADSDPFSSFYLPGFVKFFGNLAVMDSPQQICERYPIFVEKVFEMIESQDPTMIGVAVDTVGILGSNVEGKQVLQKTGTRFERLLMRIGHQSKNAPVELKIRCLDAISSLLYLPPEQQTDDLLRMTESWFSSLSRDPLELFRGISSQPFPELHCAALKVFTAIANQPWAQKLMFNSPGFVEYVVDRSVEHDKASKDAKYELVKALANSKTIAEIFGNPNYLRLRTYLSEGPYYVKPVSTTAVEGAE

SEQ ID NO: 59480 - protein, 97 aa, Homo sapiens
MRIGHQSKNAPVELKIRCLDAISSLLYLPPEQQTDDLLRMTESWFSSLSRDPLELFRGISSQPFPELHCAALKVFTGRKHLHLEELVGGNQVKNTVE

SEQ ID NO: 59481 - protein, 324 aa, Homo sapiens
MPELAVQKVVVHPLVLLSVVDHFNRIGKVGNQKRVVGVLLGSWQKKVLDVSNSFAVPFDEDDKDDSVWFLDHDYLENMYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVATGKLPINHQIIYQLQDVFNLLPDVSLQEFVKAFYLKTNDQMVVVYLASLIRSVVALHNLINNKIANRDAEKKEGQEKEESKKDRKEDKEKDKDKEKSDVKKEEKKEKK

SEQ ID NO: 59482 - protein, 247 aa, Homo sapiens
MYGMFKKVNARERIVGWYHTGPKLHKNDIAINELMKRYCPNSVLVIIDVKPKDLGLPTEAYISVEEVHDDGTPTSKTFEHVTSEIGAEEAEEVGVEHLLRDIKDTTVGTLSQRITNQVHGLKGLNSKLLDIRSYLEKVATGKLPINHQIIYQLQDVFNLLPDVSLQEFVKAFYLKTNDQMVVVYLASLIRSVVALHNLINNKIANRDAEKKEGQEKEESKKDRKEDKEKDKDKEKSDVKKEEKKEKK

SEQ ID NO: 59483 - protein, 207 aa, Homo sapiens
MSDEEARQSGGSSQAGVVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAGLQVDDEIVEFGSVNTQNFQSLHNIGSVVQHSEGALAPTILLSVSMNLTTPGTSSR

SEQ ID NO: 59484 - protein, 223 aa, Homo sapiens
MSDEEARQSGGSSQAGVVTVSDVQELMRRKEEIEAQIKANYDVLESQKGIGMNEPLVDCEGYPRSDVDLYQVRTARHNIICLQNDHKAVMKQVEEALHQLHARDKEKQARDMAEAHKEAMSRKLGQSESQGPPRAFAKVNSISPGSPASIAGLQVDDEIVEFGSVNTQNFQSLHNIGSVVQHSEGKPLNVTVIRRGEKHQLRLVPTRWAGKGLLGCNIIPLQR

SEQ ID NO: 59485 - protein, 249 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYAVLYDIILKNFEKLKKPRGETKGMIY

SEQ ID NO: 59486 - protein, 250 aa, Homo sapiens
MAMLRVQPEAQAKVDVFREDLCTKTENLLGSYFPKKISELDAFLKEPALNEANLSNLKAPLDIPVPDPVKEKEKEERKKQQEKEDKDEKKKGEDEDKGPPCGPVNCNEKIVVLLQRLKPEIKDVIEQLNLVTTWLQLQIPRIEDGNNFGVAVQEKVFELMTSLHTKLEGFHTQISKYFSERGDAVTKAAKQPHVGDYRQLVHELDEAEYRDIRLMVMEIRNAYVRRQGQGRGGQRQLSQATHSLTLQARG

SEQ ID NO: 59487 - protein, 239 aa, Homo sapiens
MAKPCGVRLSGEARKQVEVFRQNLFQEAEEFLYRFLPQKIIYLNQLLQEDSLNVADLTSLRAPLDIPIPDPPPKDDEMETDKQEKKEVHKCGFLPGNEKVLSLLALVKPEVWTLKEKCILVITWIQHLIPKIEDGNDFGVAIQEKVLERVNAVKTKVEAFQTTISKYFSERGDAVAKASKETHVMDYRALVHERDEAAYGELRAMVLDLRAFYAELYHIISSNLEKIVNPKGEEKPSMY

SEQ ID NO: 59488 - protein, 267 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGTKVFVMPNGMLKSNQQLVDIIEKVKPEIRLLIEKCNTPSGKGPHICFDLQVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 59489 - protein, 254 aa, Homo sapiens; identical to SEQ ID NO: 59458

SEQ ID NO: 59490 - protein, 15 aa, Homo sapiens
MASLLKVDQEVKLKL

SEQ ID NO: 59491 - protein, 130 aa, Homo sapiens
MASLLKVDQEVKLKVDSFRERITSEAEDLVANFFPKKLLELDSFLKEPILNIHDLTQIHSDMNLPVPDPILLTNSHDGLDGPTYKKRRLDECEEAFQGQNVGTAPDSQDRRWKQLWGVHSGGNSCRAKNC

SEQ ID NO: 59492 - protein, 193 aa, Homo sapiens
MNLPVPDPILLTNSHDGLDGPTYKKRRLDECEEAFQGTKVFVMPNGMLKSNQQLVDIIEKVKPEIRLLIEKCNTVKMWVQLLIPRIEDGNNFGVSIQEETVAELRTVESEAASYLDQISRYYITRAKLVSKIAKYPHVEDYRRTVTEIDEKEYISLRLIISELRNQYVTLHDMILKNIEKIKRPRSSNAETLY

SEQ ID NO: 59493 - protein, 1843 aa, Homo sapiens
MEPAERAGVGEPPEPGGRPEPGPRGFVPQKEIVYNKLLPYAERLDAESDLQLAQIKCNLGRAVQLQELWPGGLFWTRKLSTYIRLYGRKFSKEDHVLFIKLLYELVSIPKLEISMMQGFARLLINLLKKKELLSRADLELPWRPLYDMVERILYSKTEHLGLNWFPNSVENILKTLVKSCRPYFPADATAEMLEEWRPLMCPFDVTMQKAITYFEIFLPTSLPPELHHKGFKLWFDELIGLWVSVQNLPQWEGQLVNLFARLATDNIGYIDWDPYVPKIFTRILRSLNLPVGSSQVLVPRFLTNAYDIGHAVIWITAMMGGPSKLVQKHLAGLFNSITSFYHPSNNGRWLNKLMKLLQRLPNSVVRRLHRERYKKPSWLTPVPDSHKLTDQDVTDFVQCIIQPVLLAMFSKTGSLEAAQALQNLALMRPELVIPPVLERTYPALETLTEPHQLTATLSCVIGVARSLVSGGRWFPEGPTHMLPLLMRALPGVDPNDFSKCMITFQFIATFSTLVPLVDCSSVLQERNDLTEVERELCSATAEFEDFVLQFMDRCFGLIESSTLEQTREETETEKMTHLESLVELGLSSTFSTILTQCSKEIFMVALQKVFNFSTSHIFETRVAGRMVADMCRAAVKCCPEESLKLFVPHCCSVITQLTMNDDVLNDEELDKELLWNLQLLSEITRVDGRKLLLYREQLVKILQRTLHLTCKQGYTLSCNLLHHLLRSTTLIYPTEYCSVPGGFDKPPSEYFPIKDWGKPGDLWNLGIQWHVPSSEEVSFAFYLLDSFLQPELVKLQHCGDGKLEMSRDDILQSLTIVHNCLIGSGNLLPPLKGEPVTNLVPSMVSLEETKLYTGLEYDLSRENHREVIATVIRKLLNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 59494 - protein, 987 aa, Homo sapiens
MGENLAKKIMFFLLTIKLILNHILDNSEDDTKSLFLIIKIIGDLLQFQGSHKHEFDSRWKSFNLVKKSMENRLHGKKQHIRALLIDRVMLQHELRTLTVEGCEYKKIHQDMIRDLLRLSTSSYSQVRNKAQQTFFAALGAYNFCCRDIIPLVLEFLRPDRQGVTQQQFKGALYCLLGNHSGVCLANLHDWDCIVQTWPAIVSSGLSQAMSLEKPSIVRLFDDLAEKIHRQYETIGLDFTIPKSCVEIAELLQQSKNPSINQILLSPEKIKEGIKRQQEKNADALRNYENLVDTLLDGVEQRNLPWKFEHIGIGLLSLLLRDDRVLPLRAIRFFVENLNHDAIVVRKMAISAVAGILKQLKRTHKKLTINPCEISGCPKPTQIIAGDRPDNHWLHYDSKTIPRTKKEWESSCFVEKTHWGYYTWPKNMVVYAGVEEQPKLGRSREDMTEAEQIIFDHFSDPKFVEQLITFLSLEDRKGKDKFNPRRFCLFKGIFRNFDDAFLPVLKPHLEHLVADSHESTQRCVAEIIAGLIRGSKHWTFEKVEKLWELLCPLLRTALSNITVETYNDWGACIATSCESRDPRKLHWLFELLLESPLSGEGGSFVDACRLYVLQGGLAQQEWRVPELLHRLLKYLEPKLTQVYKNVRERIGSVLTYIFMIDVSLPNTTPTISPHVPEFTARILEKLKPLMDVDEEIQNHVMEENGIGEEDERTQGIKLLKTILKWLMASAGRSFSTAVTEQLQLLPLFFKIAPVENDNSYDELKRDAKLCLSLMSQGLLYPHQVPLVLQVLKQTARSSSWHARYTVLTYLQTMVFYNLFIFLNNEDAVKDIRWLVISLLEDEQLEVREMAATTLSGLLQCNFLTMDSPMQIHFEQLCKTKLPKKRKRDPGSVGDTIPSAELVKRHAGVLGLGACVLSSPYDVPTWMPQLLMNLSAHLNDPQPIEMTVKKTLSNFRRTHHDNWQEHKQQFTDDQLLVLTDLLVSPCYYA

SEQ ID NO: 59495 - protein, 288 aa, Homo sapiens
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSVFLCQCSCYVAEDQQYQWLEKVFGSCPRKNMQITILTCRHVTDYKTSESTGSLPSPFLRALKTQNFKDSACCPLLEQPNIVHDLPAAVLSYCQVWKIPAILYLCYTDVMKLDLITVEAFKPILSTRSLKGLVKNIPQSTEILKKLMTTNEIQSNIYT

SEQ ID NO: 59496 - protein, 267 aa, Homo sapiens
MAATFFGEVVKAPCRAGTEDEEEEEEGRRETPEDREVRLQLARKREVRLLRRQTKTSLEVSLLEKYPCSKFIIAIGNNAVAFLSSFVMNSGVWEEVGCAKLWNEWCRTTDTTHLSSTEAFCVFYHLKSNPSVFGSCPRKNMQITILTCRHVTDYKTSESTGSLPSPFLRALKTQNFKDSACCPLLEQPNIVHDLPAAVLSYCQVWKIPAILYLCYTDVMKLDLITVEAFKPILSTRSLKGLVKNIPQSTEILKKLMTTNEIQSNIYT

SEQ ID NO: 59497 - protein, 264 aa, Homo sapiens
MFVPCGESAPDLAGFTLLMPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKSRCIPEIDDSEFCIRIPGGGITKTLYDESCSKEIQMAVLLKFVSEGDNIPDALGLVEYLNEWLQILKPLSDDPTVSASRWKIPSSWRLLFGSGLPPALF

SEQ ID NO: 59498 - protein, 152 aa, Homo sapiens
MPAVSVGNVGQLAMDLIISTLNMSKIGYFYTDCLVPMVGNNPYATTEGNSTELSINAEVYSLPSRKLVALQLRSIFIKYKSKPFCEKLLSWVKSSGCARVIVLSSSHSYQRNDLQLRSTPFRYLLTPSMQKSVQNKIKSLNWEEMEKGAFLK

SEQ ID NO: 59499 - protein, 263 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 59500 - protein, 263 aa, Homo sapiens; identical to SEQ ID NO: 59499

SEQ ID NO: 59501 - protein, 269 aa, Homo sapiens
MQLSKVKFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSKTQIPTQRYGRRPYGVGLLIAGYDDMGPHIFQTCPSANYFDCRAMSIGARSQSARTYLERHMSEFMECNLNELVKHGLRALRETLPAEQDLTTKNVSIGIVGKDLEFTIYDDDDVSPFLEGLEERPQRKAQPAQPADEPAEKADEPMEH

SEQ ID NO: 59502 - protein, 164 aa, Homo sapiens
MFRNQYDNDVTVWSPQGRIHQIEYAMEAVKQGSATVGLKSKTHAVLVALKRAQSELAAHQKKILHVDNHIGISIAGLTADARLLCNFMRQECLDSRFVFDRPLPVSRLVSLIGSSILFMIWALTFSKPVHLLTILTAEPCPLEPVPNQLVLTWRDICLNLWSVI

SEQ ID NO: 59503 - protein, 234 aa, Homo sapiens
MAERGYSFSLTTFSPSGKLVQIEYALAAVAGGAPSVGIKAANGVVLATEKKQKSILYDERSVHKVEPITKHIGLVYSGMGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKRYNEDLELEDAIHTAILTLKESFEGQMTEDNIEVGICNEAGFRRLTPTEVKDYLAAIA

SEQ ID NO: 59504 - protein, 99 aa, Homo sapiens
MGPDYRVLVHRARKLAQQYYLVYQEPIPTAQLVQRVASVMQEYTQSGGVRPFGVSLLICGWNEGRPYLFQSDPSGAYFAWKATAMGKNYVNGKTFLEKR

SEQ ID NO: 59505 - protein, 255 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSFMLGSYSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 59506 - protein, 248 aa, Homo sapiens
MSSIGTGYDLSASTFSPDGRVFQVEYAMKAVENSSTAIGIRCKDGVVFGVEKLVLSKLYEEGSNKRLFNVDRHVGMAVAGLLADARSLADIAREEASNFRSNFGYNIPLKHLADRVAMYVHAYTLYSAVRPFGCSVNDGAQLYMIDPSGVSYGYWGCAIGKARQAAKTEIEKLQMKEMTCRDIVKEVAKIIYIVHDEVKDKAFELELSWVGELTNGRHEIVPKDIREEAEKYAKESLKEEDESDDDNM

SEQ ID NO: 59507 - protein, 261 aa, Homo sapiens
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 59508 - protein, 190 aa, Homo sapiens
MACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 59509 - protein, 261 aa, Homo sapiens; identical to SEQ ID NO: 59507

SEQ ID NO: 59510 - protein, 221 aa, Homo sapiens
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENG

SEQ ID NO: 59511 - protein, 209 aa, Homo sapiens
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAE

SEQ ID NO: 59512 - protein, 230 aa, Homo sapiens
MSRRYDSRTTIFSPEAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQLIKKHEEEEAKAEREKKEKEQKEKDK

SEQ ID NO: 59513 - protein, 236 aa, Homo sapiens
MSRRYDSRTTIFSPEGRLYQVEYAMEAIGHAGTCLGILANDGVLLAAERRNIHKLLDEVFFSEKIYKLNEDMACSVAGITSDANVLTNELRLIAQRYLLQYQEPIPCEQLVTALCDIKQAYTQFGGKRPFGVSLLYIGWDKHYGFQLYQSDPSGNYGGWKATCIGNNSAAAVSMLKQDYKEGEMTLKSALALAIKVLNKTMDVSKLSAEKVEIATLTRENGKTVIRVLKQKEVEQL

SEQ ID NO: 59514 - protein, 241 aa, Homo sapiens
MFLTRSEYDRGVNTFSPEGRLFQVEYAIEAIKLGSTAIGIQTSEGVCLAVEKRITSPLMEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 59515 - protein, 183 aa, Homo sapiens
MEPSSIEKIVEIDAHIGCAMSGLIADAKTLIDKARVETQNHWFTYNETMTVESVTQAVSNLALQFGEEDADPGAMSRPFGVALLFGGVDEKGPQLFHMDPSGTFVQCDARAIGSASEGAQSSLQEVYHKSMTLKEAIKSSLIILKQVMEEKLNATNIELATVQPGQNFHMFTKEELEEVIKDI

SEQ ID NO: 59516 - protein, 246 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 59517 - protein, 227 aa, Homo sapiens
MAGLRREYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 59518 - protein, 252 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCWSFLFLGMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 59519 - protein, 107 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTVSLCRPGCSASWVQAILVPQPPR

SEQ ID NO: 59520 - protein, 148 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCYCNYMPVYCSIN

SEQ ID NO: 59521 - protein, 167 aa, Homo sapiens
MTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVETAITCLSTVLSIDFKPSEIEVGVVTVENPKFRILTEAEIDAHLVALAERD

SEQ ID NO: 59522 - protein, 203 aa, Homo sapiens
MSRGSSAGFDRHITIFSPEGRLYQVEYAFKAINQGGLTSVAVRGKDCAVIVTQKKVPDKLLDSSTVTHLFKITENIGCVMTGMTADSRSQVQRARYEAANWKYKYGYEIPVDMLCKRIADISQVYTQNAEMRPLGCCMILIGIDEEQGPQVYKCDPAGYYCGFKATAAGVKQTESTSFLEKKVKKKFDWTFEQTVEDSYRSRD

SEQ ID NO: 59523 - protein, 149 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQVGACPLACSPLAAGQSRLRHGGSCHVTSGESEN

SEQ ID NO: 59524 - protein, 178 aa, Homo sapiens
MAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 59525 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 59526 - protein, 187 aa, Homo sapiens
  MOD_RES (1)..(1): Any amino acid
XLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEGKVVNAPVFCPFKVVQSGGKNIELAVMRRDQSLKILNPEEIEKYVAEIEKEKEENEKKKQKKAS

SEQ ID NO: 59527 - protein, 241 aa, Homo sapiens
MLSSTAMYSAPGRDLGMEPHRAAGPLQLRFSPYVFNGGTILAIAGEDFAIVASDTRLSEGFSIHTRDSPKCYKLTDKTVIGCSGFHGDCLTLTKIIEARLKMYKHSNNKAMTTGAIAAMLSTILYSRRFFPYYVYNIIGGLDEEGKGAVYSFDPVGSYQRDSFKAGGSASAMLQPLLDNQVGFKNMQNVEHVPLSLDRAMRLVKDVFISAAERDVYTGDALRICIVTKEGIREETVSLRKD

SEQ ID NO: 59528 - protein, 196 aa, Homo sapiens
RRSRAMLSSTAMYSAPGRDLGMEPHRAAGPLQLRFSPYVFNGGTILAIAGEDFAIVASDTRLSEGFSIHTRDSPKCYKLTDKTVIGCSGFHGDCLTLTKIIEARLKMYKHSNNKAMTTGAIAAMLSTILYSRRFFPYYVYNIIGGLDEEGKGAVYSFDPVGSYQRDSFKAGGSASAMLQPLLDNQYISSNSVSLCV

SEQ ID NO: 59529 - protein, 273 aa, Homo sapiens
MLKPALEPRGGFSFENCQRNASLERVLPGLKVPHARKTGTTIAGLVFQDGVILGADTRATNDSVVADKSCEKIHFIAPKIYCCGAGVAADAEMTTRMVASKMELHALSTGREPRVATVTRILRQTLFRYQGHVGASLIVGGVDLTGPQLYGVHPHGSYSRLPFTALGSGQDAALAVLEDRFQPNMTLEAAQGLLVEAVTAGILGDLGSGGNVDACVITKTGAKLLRTLSSPTEPVKRSGRYHFVPGTTAVLTQTVKPLTLELVEETVQAMEVE

SEQ ID NO: 59530 - protein, 300 aa, Homo sapiens
MALQDVCKWQSPDTQGPSPHLPRAGGWAVPRGCDPQTFLQIHGPRLAHGTTTLAFRFRHGVIAAADTRSSCGSYVACPASCKVIPVHQHLLGTTSGTSADCATWYRVLQRELRLRELREGQLPSVASAAKLLSAMMSQYRGLDLCVATALCGWDRSGPELFYVYSDGTRLQGDIFSVGSGSPYAYGVLDRGYRYDMSTQEAYALARCAVAHATHRDAYSGGSVDLFHVRESGWEHVSRSDACVLYVELQKLLEPEPEEDASHAHPEPATAHRAAEDRELSVGPGEVTPGDSRMPAGTETV

SEQ ID NO: 59531 - protein, 201 aa, Homo sapiens
MEYLIGIQGPDYVLVASDRVAASNIVQMKDDHDKMFKMSEKILLLCVGEAGDTVQFAEYIQKNVQLYKMRNGYELSPTAAANFTRRNLADCLRSRTPYHVNLLLAGYDEHEGPALYYMDYLAALAKAPFAAHGYGAFLTLSILDRYYTPTISRERAVELLRKCLEELQKRFILNLPTFSVRIIDKNGIHDLDNISFPKQGS

SEQ ID NO: 59532 - protein, 205 aa, Homo sapiens
MSIMSYNGGAVMAMKGKNCVAIAADRRFGIQAQMVTTDFQKIFPMGDRLYIGLAGLATDVQTVAQRLKFRLNLYELKEGRQIKPYTLMSMVANLLYEKRFGPYYTEPVIAGLDPKTFKPFICSLDLIGCPMVTDDFVVSGTCAEQMYGMCESLWEPNMDPDHLFETISQAMLNAVDRDAVSGMGVIVHIIEKDKITTRTLKARMD

SEQ ID NO: 59533 - protein, 264 aa, Homo sapiens
MEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYRDARSYNRFQIATVTEKGVEIEGPLSTETNWDIAHMISGFE

SEQ ID NO: 59534 - protein, 263 aa, Homo sapiens
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 59535 - protein, 160 aa, Homo sapiens
MAGGAADCSFWERLLARQCRIYELRNKERISVAAASKLLANMVYQYKGMGLSMGTMICGWDKRGPGLYYVDSEGNRISGATFSVGSGSVYAYGVMDRGYSYDLEVEQAYDLARRAIYQATYRDAYSGGAVNLYHVREDGWIRVSSDNVADLHEKYSGSTP

SEQ ID NO: 59536 - protein, 203 aa, Homo sapiens
MALASVLERPLPVNQRGFFGLGGRADLLDLGPGSLSDGLSLAAPGWGVPEEPGIEMLHGTTTLAFKFRHGVIVAADSRATAGAYIASQTVKKVIEINPYLLGTMAGGAADCSFWERLLARQCRIYELRNKERISVAAASKLLANMVYQYKGMGLSMGTMICGWDKRGPVSEVLCLKPKSFGMYLFCGCAERIGNMARPLLRGQ

SEQ ID NO: 59537 - protein, 277 aa, Homo sapiens
MAAVSVYAPPVGGFSFDNCRRNAVLEADFAKRGYKLPKVRKTGTTIAGVVYKDGIVLGADTRATEGMVVADKNCSKIHFISPNIYCCGAGTAADTDMTTQLISSNLELHSLSTGRLPRVVTANRMLKQMLFRYQGYIGAALVLGGVDVTGPHLYSIYPHGSTDKLPYVTMGSGSLAAMAVFEDKFRPDMEEEEAKNLVSEAIAAGIFNDLGSGSNIDLCVISKNKLDFLRPYTVPNKKGTRLGRYRCEKGTTAVLTEKITPLEIEVLEETVQTMDTS

SEQ ID NO: 59538 - protein, 210 aa, Homo sapiens
MAAVSVYAPPVGGFSFDNCRRNAVLEADFAKRGYKLPKVRKTGTTIAGVVYKDGIVLGADTRATEGMVVADKNCSKIHFISPNIYCCGAGTAADTDMTTQLISSNLELHSLSTGRLPRVVTANRMLKQMLFRYQGYIGAALVLGGVDVTGPHLYSIYPHGSTDKLPYVTMVHCEEELFTENLFFIRQAEVVSEEAWGPSFAISLAVFLVA

SEQ ID NO: 59539 - protein, 142 aa, Homo sapiens
MAAVSVYAPPVGGFSFDNCRRNAVLEADFAKRGYKLPKVRKTGTTIAGVVYKDGIVLGADTRATEGMVVADKNCSKIHFISPNIYCCGAGTAADTDMTTQLISSNLELHSLSTGRLPRVVTANRMLKQMLFRFWLLGSNGCI

SEQ ID NO: 59540 - protein, 272 aa, Homo sapiens
MLIGTPTPRDTTPSSWLTSSLLVEAAPLDDTTLPTPVSSGCPGLEPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 59541 - protein, 276 aa, Homo sapiens
MALLDVCGAPRGQRPESALPVAGSGRRSDPGHYSFSMRSPELALPRGMQPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 59542 - protein, 276 aa, Homo sapiens; identical to SEQ ID NO: 59541

SEQ ID NO: 59543 - protein, 272 aa, Homo sapiens; identical to SEQ ID NO: 59540

SEQ ID NO: 59544 - protein, 252 aa, Homo sapiens
MALLDVCGAPRGQRPESALPVAGSGRRSDPGHYSFSMRSPELALPRGMQPTEFFQSLGGDGERNVQIEMAHGTTTLAFKFQHGVIAAVDSRASAGSYINCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 59545 - protein, 252 aa, Homo sapiens; identical to SEQ ID NO: 59544

SEQ ID NO: 59546 - protein, 272 aa, Homo sapiens; identical to SEQ ID NO: 59540

SEQ ID NO: 59547 - protein, 272 aa, Homo sapiens; identical to SEQ ID NO: 59540

SEQ ID NO: 59548 - protein, 276 aa, Homo sapiens; identical to SEQ ID NO: 59541

SEQ ID NO: 59549 - protein, 252 aa, Homo sapiens; identical to SEQ ID NO: 59544

SEQ ID NO: 59550 - protein, 252 aa, Homo sapiens; identical to SEQ ID NO: 59544

SEQ ID NO: 59551 - protein, 276 aa, Homo sapiens; identical to SEQ ID NO: 59541

SEQ ID NO: 59552 - protein, 272 aa, Homo sapiens; identical to SEQ ID NO: 59540

SEQ ID NO: 59553 - protein, 272 aa, Homo sapiens; identical to SEQ ID NO: 59540

SEQ ID NO: 59554 - protein, 276 aa, Homo sapiens; identical to SEQ ID NO: 59541

SEQ ID NO: 59555 - protein, 272 aa, Homo sapiens; identical to SEQ ID NO: 59540

SEQ ID NO: 59556 - protein, 276 aa, Homo sapiens
MALLDVCGAPRGQRPESALPVAGSGRRSDPGHYSFSMRSPELALPRGMKPTEFFQSLGGDGERNVQIEMAHGTTTLAFKFQHGVIAAVDSRASAGSYISALRVNKVIEINPYLLGTMSGCAADCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 59557 - protein, 252 aa, Homo sapiens; identical to SEQ ID NO: 59544

SEQ ID NO: 59558 - protein, 252 aa, Homo sapiens; identical to SEQ ID NO: 59544

SEQ ID NO: 59559 - protein, 252 aa, Homo sapiens
MALLDVCGAPRGQRPESALPVAGSGRRSDPGHYSFSMRSPELALPRGMKPTEFFQSLGGDGERNVQIEMAHGTTTLAFKFQHGVIAAVDSRASAGSYINCQYWERLLAKECRLYYLRNGERISVSAASKLLSNMMCQYRGMGLSMGSMICGWDKKGPGLYYVDEHGTRLSGNMFSTGSGNTYAYGVMDSGYRPNLSPEEAYDLGRRAIAYATHRDSYSGGVVNMYHMKEDGWVKVESTDVSDLLHQYREANQ

SEQ ID NO: 59560 - protein, 272 aa, Homo sapiens; identical to SEQ ID NO: 59540

SEQ ID NO: 59561 - protein, 276 aa, Homo sapiens; identical to SEQ ID NO: 59541

SEQ ID NO: 59562 - protein, 276 aa, Homo sapiens; identical to SEQ ID NO: 59541

SEQ ID NO: 59563 - protein, 252 aa, Homo sapiens; identical to SEQ ID NO: 59544

SEQ ID NO: 59564 - protein, 276 aa, Homo sapiens; identical to SEQ ID NO: 59541

SEQ ID NO: 59565 - protein, 219 aa, Homo sapiens
MLRAGAPTGDLPRAGEVHTGTTIMAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 59566 - protein, 219 aa, Homo sapiens; identical to SEQ ID NO: 59565

SEQ ID NO: 59567 - protein, 219 aa, Homo sapiens; identical to SEQ ID NO: 59565

SEQ ID NO: 59568 - protein, 196 aa, Homo sapiens
MAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 59569 - protein, 178 aa, Homo sapiens
MLRAGAPTGDLPRAGEVHTGTTIMAVEFDGGVVMGSDSRVSAGIELEEPPLVLAAANVVRNISYKYREDLSAHLMVAGWDQREGGQVYGTLGGMLTRQPFAIGGSGSTFIYGYVDAAYKPGMSPEECRRFTTDATSTKRRVCGYFLRTQKRENQNQRVHEYMCTGERSLSSSPLLSCS

SEQ ID NO: 59570 - protein, 196 aa, Homo sapiens; identical to SEQ ID NO: 59568

SEQ ID NO: 59571 - protein, 178 aa, Homo sapiens; identical to SEQ ID NO: 59569

SEQ ID NO: 59572 - protein, 196 aa, Homo sapiens; identical to SEQ ID NO: 59568

SEQ ID NO: 59573 - protein, 178 aa, Homo sapiens; identical to SEQ ID NO: 59569

SEQ ID NO: 59574 - protein, 131 aa, Homo sapiens
MAVEFDGGVVMGSDSRVSAGEAVVNRVFDKLSPLHERIYCALSGSAADAQAVADMAAYQLELHGIELEEPPLVLAAANVVRNISYKYREDLSAHLMVAGWDQREGGQVYGTLGGMLTRQPFAIGGSGSTFI

SEQ ID NO: 59575 - protein, 131 aa, Homo sapiens; identical to SEQ ID NO: 59574

SEQ ID NO: 59576 - protein, 131 aa, Homo sapiens; identical to SEQ ID NO: 59574

SEQ ID NO: 59577 - protein, 131 aa, Homo sapiens; identical to SEQ ID NO: 59574

SEQ ID NO: 59578 - protein, 178 aa, Homo sapiens
MLRAGAPTGDLPRAGEVHTGTTIMAVEFDGGVVMGSDSRVSAGIELEEPPLVLAAANVVRNISYKYREDLSAHLMVAGWDQREGGQVYGTLGGMLTRQPFAIGGSGSTFIYGYVDAAYKPGMSPEECRRFTTDATSTKRRVCGYFLRTQKRENQNQRVHEYMCTSERSLSSSPLLSCS

SEQ ID NO: 59579 - protein, 131 aa, Homo sapiens
MAVEFDGGVVMGSDSRVSAGEAVVNRVFDKLSPLHEHIYCALSGSAADAQAVADMAAYQLELHGIELEEPPLVLAAANVVRNISYKYREDLSAHLMVAGWDQREGGQVYGTLGGMLTRQPFAIGGSGSTFI

SEQ ID NO: 59580 - protein, 196 aa, Homo sapiens; identical to SEQ ID NO: 59568

SEQ ID NO: 59581 - protein, 219 aa, Homo sapiens; identical to SEQ ID NO: 59565

SEQ ID NO: 59582 - protein, 196 aa, Homo sapiens
MAVEFDGGVVMGSDSRVSAGEAVVNRVFDKLSPLHEHIYCALSGSAADAQAVADMAAYQLELHGIELEEPPLVLAAANVVRNISYKYREDLSAHLMVAGWDQREGGQVYGTLGGMLTRQPFAIGGSGSTFIYGYVDAAYKPGMSPEECRRFTTDAIALAMSRDGSSGGVIYLVTITAAGVDHRVILGNELPKFYDE

SEQ ID NO: 59583 - protein, 178 aa, Homo sapiens; identical to SEQ ID NO: 59578

SEQ ID NO: 59584 - protein, 178 aa, Homo sapiens; identical to SEQ ID NO: 59578

SEQ ID NO: 59585 - protein, 219 aa, Homo sapiens [sequence omitted]

SEQ ID NO: 59586 - protein, 196 aa, Homo sapiens; identical to SEQ ID NO: 59582

SEQ ID NO: 59587 - protein, 219 aa, Homo sapiens [sequence omitted]

SEQ ID NO: 59588 - protein, 131 aa, Homo sapiens; identical to SEQ ID NO: 59574

SEQ ID NO: 59589 - protein, 131 aa, Homo sapiens; identical to SEQ ID NO: 59579

SEQ ID NO: 59590 - protein, 196 aa, Homo sapiens; identical to SEQ ID NO: 59582

SEQ ID NO: 59591 - protein, 219 aa, Homo sapiens; identical to SEQ ID NO: 59565

SEQ ID NO: 59592 - protein, 178 aa, Homo sapiens; identical to SEQ ID NO: 59569

SEQ ID NO: 59593 - protein, 178 aa, Homo sapiens; identical to SEQ ID NO: 59569

SEQ ID NO: 59594 - protein, 196 aa, Homo sapiens; identical to SEQ ID NO: 59568

SEQ ID NO: 59595 - protein, 219 aa, Homo sapiens [sequence omitted]

SEQ ID NO: 59596 - protein, 154 aa, Homo sapiens
MLRAGAPTGDLPRAGEVHTGTTIMAVEFDGGVVMGSDSRVSAGIELEEPPLVLAAANVVRNISYKYREDLSAHLMVAGWDQREGGQVYGTLGGMLTRQPFAIGGSGSTFIYGYVDAAYKPGMSPEECRRFTTDGNQPSGRVPGEGFETWEGSRL

SEQ ID NO: 59597 - protein, 131 aa, Homo sapiens; identical to SEQ ID NO: 59579

SEQ ID NO: 59598 - protein, 154 aa, Homo sapiens; identical to SEQ ID NO: 59596

SEQ ID NO: 59599 - protein, 154 aa, Homo sapiens; identical to SEQ ID NO: 59596

SEQ ID NO: 59600 - protein, 154 aa, Homo sapiens; identical to SEQ ID NO: 59596

SEQ ID NO: 59601 - protein, 154 aa, Homo sapiens; identical to SEQ ID NO: 59596

SEQ ID NO: 59602 - protein, 154 aa, Homo sapiens; identical to SEQ ID NO: 59596

SEQ ID NO: 59603 - protein, 154 aa, Homo sapiens; identical to SEQ ID NO: 59596

SEQ ID NO: 59604 - protein, 154 aa, Homo sapiens; identical to SEQ ID NO: 59596

SEQ ID NO: 59605 - protein, 141 aa, Homo sapiens
MNARGLGSELKDSIPVTELSASGPFESHDLLRKGFSCVKNELLPSHPLELSEKNFQLNQDKMNFSTLRNIQGLFAPLKLQMEFKAVQQVQRLPFLSSSNLSLDVLRGNDETIGFEDILNDPSQSEVMGEPHLMVEYKLGLL

SEQ ID NO: 59606 - protein, 156 aa, Homo sapiens
MPMAGLLKGLVRQLERFSVQQQASKMPPKGKSGSGKAGKGGAASGSDSADKKAQGPKGGGNAVKVRHILCEKHGKIMEAMEKLKSGMRFNEVAAQYSEDKARQGGDLGWMTRGSMVGPFQEAAFALPVSGMDKPVFTDPPVKTKFGYHIIMVEGRK

SEQ ID NO: 59607 - protein, 133 aa, Homo sapiens
MPMAGLLKGLVRQLERFSVQQQASKMPPKGKSGSGKAGKGGAASGSDSADKKAQGPKGGGNAVKVRHILCEKHGKIMEAMEKLKSGMRFNEVAAQYSEDKARQGIPSLQQHAGHHRDLRSTLISLVSYLQTTP

SEQ ID NO: 59608 - protein, 353 aa, Homo sapiens
MAAAEAANCIMEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 59609 - protein, 293 aa, Homo sapiens
MVGVAEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKVRGWAWPGAPWVETKERPSPGPGMGLWGPECWPEVSEPDLPARGGARGPGKTLRPLNIFVSAAV

SEQ ID NO: 59610 - protein, 371 aa, Homo sapiens
MAAAEAANCIMENFVATLANGMSLQPPLEEVSCGQAESSEKPNAEDMTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKEVDIYTVKVEDLTFTSPFCLQVKRNDYVHALVAYFNIEFTRCHKRTGFSTSPESPYTHWKQTVFYMEDYLTVKTGEEIFGTIGMRPNAKNNRDLDFTIDLDFKGQLCELSCSTDYRMR

SEQ ID NO: 59611 - protein, 160 aa, Homo sapiens
MTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDR

SEQ ID NO: 59612 - protein, 205 aa, Homo sapiens
MTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACL

SEQ ID NO: 59613 - protein, 160 aa, Homo sapiens; identical to SEQ ID NO: 59611

SEQ ID NO: 59614 - protein, 209 aa, Homo sapiens
MTSKDYYFDSYAHFGIHEEMLKDEVRTLTYRNSMFHNRHLFKDKVVLDVGSGTGILCMFAAKAGARKVIGIECSSISDYAVKIVKANKLDHVVTIIKGKVEEVELPVEKVDIIISEWMGYCLFYESMLNTVLYARDKWLAPDGLIFPDRATLYVTAIEDRQYKDYKIHWWENVYGFDMSCIKDVAIKEPLVDVVDPKQLVTNACLIKVR

SEQ ID NO: 59615 - protein, 228 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLVGEKVFPIWR

SEQ ID NO: 59616 - protein, 284 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLAAPLLSCRILPCTCASGPLHVLLACCLPLPCTCASVPLHVLLACCLPVLRAPQPSGLHLSWPIFLL

SEQ ID NO: 59617 - protein, 433 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKSLAVKEFFSKPKYNHILKPEDCLSEPCTILQLDMRTVQISDLETLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 59618 - protein, 161 aa, Homo sapiens
MLADQPRTTKYHSVILQNKESLRIKSSWTWAVGLGSSVSSVHTMRGLERVYAVEASEMAQHTGQLVLQNGFADIITVYQQKVEDVVLPEKVDVLVSEWMGTCLLFEFMIESILYARDAWLKETGSFGPPWLRCTLCPAVLIRIIVARCSSGTTRTSSTSAL

SEQ ID NO: 59619 - protein, 433 aa, Homo sapiens; identical to SEQ ID NO: 59617

SEQ ID NO: 59620 - protein, 433 aa, Homo sapiens; identical to SEQ ID NO: 59617

SEQ ID NO: 59621 - protein, 331 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLTLRGELRFDIRKAGTLHGFTAWFSVHFQSLQEGQPPQVLSTGPFHPTTHWKQTLFMMDDPVPVHTGDVVTGSVVLQRNPVWRRHMSVALSWAVTSRQDPTSQKVGEKVFPIWR

SEQ ID NO: 59622 - protein, 289 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLFEFMIESILYARDAWLKEDGVIWPTMAALHLVPCSADKDYRSKVLFWDNAYEFNLSALKLEKKSSPSGDDS

SEQ ID NO: 59623 - protein, 301 aa, Homo sapiens
MATSGDCPRSESQGEEPAECSEAGLLQEGVQPEEFVAIADYAATDETQLSFLRGEKILILRQTTADWWWGERAGCCGYIPANHVGKHVDEYDPEDTWQDEEYFGSYGTLKLHLEMLADQPRTTKYHSVILQNKESLTDKVILDVGCGTGIISLFCAHYARPRAVYAVEASEMAQHTGQLVLQNGFADIITVYQQKVEDVVLPEKVDVLVSEWMGTCLLHHTLEADAVHDGRPSPCPYRRRGHGFSCVAEKPSVEKAHVCGSELGCHFQTRPHISKSWRKSLPHLEMTVDALFGKQCAYLEG

SEQ ID NO: 59624 - protein, 316 aa, Homo sapiens
MIADRVRTDAYRLGILRNWAALRGKTVLDVGAGTGILSIFCAQAGARRVYAVEASAIWQQAREVVRFNGLEDRVHVLPGPVETVELPEQVDAIVSEWMGYGLLHESMLSSVLHARTKWLKEGGLLLPASAELFIAPISDQMLEWRLGFWSQVKQHYGVDMSCLEGFATRCLMGHSEIVVQGLSGEDVLARPQRFAQLELSRAGLEQELEAGVGGRFRCSCYGSAPMHGFAIWFQVTFPGGESEKPLVLSTSPFHPATHWKQALLYLNEPVQVEQDTDVSGEITLLPSRDNPRRLRVLLRYKVGDQEEKTKDFAMED

SEQ ID NO: 59625 - protein, 375 aa, Homo sapiens
MSQPKKRKLESGGGGEGGEGTEEEDGAEREAALERPRRTKRERDQLYYECYSDVSVHEEMIADRVRTDAYRLGILRNWAALRGKTVLDVGAGTGILSIFCAQAGARRVYAVEASAIWQQAREVVRFNGLEDRVHVLPGPVETVELPEQVDAIVSEWMGYGLLHESMLSSVLHARTKWLKEGGLLLPASAELFIAPISDQMLEWRLGFWSQVKQHYGVDMSCLEGFATRCLMGHSEIVVQGLSGEDVLARPQRFAQLELSRAGLEQELEAGVGGRFRCSCYGSAPMHGFAIWFQVTFPGGESEKPLVLSTSPFHPATHWKQALLYLNEPVQVEQDTDVSGEITLLPSRDNPRRLRVLLRYKVGDQEEKTKDFAMED

SEQ ID NO: 59626 - protein, 311 aa, Homo sapiens
MARSGRRPWSDPGGLSGAVQRAGGPGARPAGTSGDCRVAGTGGCHRERVDGLRTPARVHAELRPPRANQVAEGGRSSPAGLRRALHSPHQRPDAGMAPGLLEPGEAALWCGHELPGGLRHALSHGPLGDRCAGIVRRGRAGPAAALCSARALPRRLGAGAGGRSGRALPLQLLWLGAHAWLCHLVPGDLPWRGVGETPGAVHLAFSPGHSLETGAPLPERAGASGARHGRFRRDHAAALPGQPPSPARAAALQSGRPGGEDQRLCHGGLSVAFSPSYLPKQPDLRGRGVARSEGKGRSHVQVGGISPPFPS

SEQ ID NO: 59627 - protein, 238 aa, Homo sapiens
MLTTLLPILLLSGWAFCSQDASDGLQRLHMLQISYFRDPYHVWYQGNASLGGHLTHVLEGPDTNTTIIQLQPLQEPESWARTQSGLQSYLLQFHGLVRLVHQERTLAFPLTIRCFLGCELPPEGSRAHVFFEVAVNGSSFVSFRPERALWQADTQVTSGVVTFTLQQLNAYNRTRYELREFLEDTCVQYVQKHISAENTKGSQTSRSYTSLVLGVLVGSFIIAGVAVGIFLCTGGRRC

SEQ ID NO: 59628 - protein, 238 aa, Homo sapiens; identical to SEQ ID NO: 59627

SEQ ID NO: 59629 - protein, 1516 aa, Homo sapiens
MDNQQDKAIVASANGENTLINGVKENDSEDQDVAMKSFAALEAAAPIQPTPVAQKETLMYPRGLLPLPSKKPCMQSPPSPLGLIEAPEHAANSASVNAISLTSGIAKGLNTWSLPNECEKAPFAIMEPAGMSALNGDCLMQPSRTCLGCFMESKDAVDPEPGISLKVGDLNRDYETCAVSDIGIQCINAGENMKYGEQLLSDQLLGFPLHKSRAGDRRETEKPDIDLEDPAQKSYYEALLLDKCNTEEALLANSNQDWGYFETFISESKIELLDLCSKNELSVNLFSEEDVDNYMFDDDESTLGSDVCSLKIRYESFQDNVRDKTTLLMQEDAQFNFFPSVFTTCPKRESKSGALKQSSDFSQFKVPDVSIIWGEEDKNLDKKKGKEEGQEDKGVEKKDGKDNGEKPALNKPCSGTEVEQLKNPKQGHLANSLETSGSFSDDSSFIEISYDAMGEIKDCSRYMARDTNSGSSSSQQNYGLRAKRKVRYSEDYLYDVDSLEGEKVNERKEWLPVGSKEEDDDEWCPKKRRKVTRKEPPVIIKYIIINRFKGEKNMLVKLGKVDASETTVNLSENQLNKYAKLAPLKGFWQKKKKQRNTNTDSIKTPFSQKQSFEPGSFEVSFLPPARKRKSKLGNRHRIQRIPSIEISASSKQISLCNDQRHASNHKEDGGLKGTLKSAPLGAPSCANGSHLNDITGPDSVKVKAQDTEFKGPERKVLNKIKFKSEARLKSKKVKAAGQESKPIVQMSPLLENQSSKANLKNEVIPGTSNSSRLSEFHEAKAAKSSTFLPTTCSSEMPLSSANVTTNIPVIPGGYLQTLLDASDLSNNTSISYFSHHSPEQNEGSLTQTEKSFVPLQPTQDCVLTSSSDSELQQSSHNFKMESSNYRNVWPNKATSGTQEFMAEVSREIAPTQSSEFGASQVVSMENNLTPTTYNPICLNSGGSNCNKVLYDSMQDTQLPSDDSYQLCHFNNGEICFPFQQGPVNMDDGRLFSFDSMAPLSVSSSNYCSLSLKSCEKDGDDDITDDFLAHCSPKLVIQQSIDEIAPLKESTDLLDISNFTPDKFRHSSLSEMSPPDTPSLSPQITRCESMKTLGTLKGFQEGVPGPLDSVEKIKWDCSTLSRQVQMEDGFTLNNHQFQFHMFNDEDSVSLLQKNPCLSTFNDPSGQISTNNKVSKSRKKSSPSKSGAMNQSSSQKNTRKKSLKGNNKGIEKPPGKNSRQVPKSTKKGKYMAAINGEKMQIGIGRGGSQTNTISSTGKTLAECIQHGGPMASMKMPSQKGLSGDWALGKESSPGWSDMSMGTNTNSLLDDDQREFQEPSYILSNIASGMADVQRFMMASIEPLWEPMEHHGDPNIFYSPESNSLKLKTLKILAGTPQESKKKINSGSQGATKNHRSIKGVSKSNGKTAIGDPGRANMPGYNEDSRSTFFDKKYSNMSTLGNNGPTHKKLYRHKSSSKALRDEKCKGKHMEREQVHKDESGTASFEKLRDSDYNLLKAETTFWVLPVFEEETRIFQKDI

SEQ ID NO: 59630 - protein, 1361 aa, Homo sapiens
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNWLVRHPDCINVPDWRGAICSGCYAQMYIQAYKTSNLRMKIIKNDFPSHPLYLEGALTRSTHYQQYQPVVTLQKGYTIHWDQTAPAELAIWLINFNKGDWIRVGLCYPRGTTFSILSDVHNRLLKQTSKTGVFVRTLQMDKVEQSYPGRSHYYWDEDSGLLFLKLKAQNEREKFAFCSMKGCERIKIKALIPKNAGVSDCTATAYPKFTERAVVDVPMPKKLFGSQLKTKDHFLEVKMESSKQHFFHLWNDFAYIEVDGKKYPSSEDGIQVVVIDGNQGRVVSHTSFRNSILQGIPWQLFNYVATIPDNSIVLMASKGRYVSRGPWTRVLEKLGADRGLKLKEQMAFVGFKGSFRPIWVTLDTEDHKAKIFQVVPIPVVKKKKL

SEQ ID NO: 59631 - protein, 1884 aa, Homo sapiens
MHCTNPALIFLIDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGIVPTPGRNLVLYPTDAYSHLSSRTLPEIVASLTEGVETTLFLSSRSLMPQPLGDGITIPLPSLGEVSQPPEEVWATSADRYTDVTTVLSQSLEETISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSSFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREAVPRTSGREPSAPSGNLPHRGLQGPGLGYPTSSTEDLQPGHSSASLIKAIREELLRLSQKQSTVQNFHS

SEQ ID NO: 59632 - protein, 411 aa, Homo sapiens
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTRGDAGEEEEKREKWCHMTQEERDDSLRFNENITFGQLGTFTHNMLAFGLNKKLCNDFLKKQAVIGNLDEEQYKLLSDHIEQMATE

SEQ ID NO: 59633 - protein, 5005 aa, Homo sapiens
MDQRKNESIVPSITQLEDFLTEHNSNVVWLLVATILSCGWIIYLTYYNSRNVGLILTLVLNRLYKHGYIHIGSFSFSVLSGKVMVREIYYITEDMSIRIQDGFIIFRWWKMYNPKQKQHDPKAETRLYITVNDFEFHVYNRSDLYGRLQELFGLEPTIIPPKKDDDKTREIGRTRTQSKIERVKVKTESQDPTSSWRSLIPVIKVNVSTGRLAFGNHYQPQTLCINFDDAFLTYTTKPPSSHLDQFMHIVKGKLENVRVMLVPSPRYVGLQNDEPPRLMGEGFVVMQSNDVDIYYYMDEPGLVPEETEENIEGEMSSEDCKLQDLPPCWGLDIVCGKGTDFNYGPWADRQRDCLWKFFFPPDYQVLKVSEIAQPGRPRQILAFELRMNIIADATIDLLFTKNRETNAVHVNVGAGSYLEINIPMTVEENGYTPAIKGQLLHVDATTSMQYRTLLEAEMLAFHINASYPRIWNMPQTWQCELEVYKATYHFIFAQKNFFTDLIQDWSSDSPPDIFSFVPYTWNFKIMFHQFEMIWAANQHNWIDCSTKQQENVYLAACGETLNIDFSLPFTDFVPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQLACLLEWGQTFVFHVVCREYELERPKSVIICQHGIDRRFCESKLSCIPGPCPTSDDLKYTMIRLAVDGADIYIVEHGCATNIKMGAIRVANCNLHNQSVGEGISAAIQDFQVRQYIEQLNNCRIGLQPAVLRRAYWLEAGSANLGLITVDIALAADHHSKHEAQRHFLETHDARTKRLWFLWPDDILKNKRCRNKCGCLGGCRFFGGTVTGLDFFKLEELTPSSSSAFSSTSAESDMYYGQSLLQPGEWIITKEIPKIIDGNVNGMKRKEWENKSVGIEVERKTQHLSLQVPLRSHSSSSSSEENSSSSAAQPLLAGEKESPSSVADDHLVQKEFLHGTKRDDGQASIPTEISGNSPVSPNTQDKSVGQSPLRSPLKRQASVCSTRLGSTKSLTAAFYGDKQPVTVGVQFSSDVSRSDENVLDSPKQRRSFGSFPYTPSADSNSFHQYRSMDSSMSMADSEAYFSAAEEFEPISSDEGPGTYPGRKKKKKQTQQIDYSRGSIYHSVEGPLTGHGESIQDSRTLPFKTHPSQASFVSALGGEDDVIEHLYIVEGEKTVESEQITPQQPVMNCYQTYLTQFQVINWSVKHPTNKRTSKSSLHRPLDLDTPTSEESSSSFEQLSVPTFKVIKQGLTANSLLDRGMQLSGSTSNTPYTPLEKKLADNTDDETLTEEWTLDQPVSQTRTTAIVEVKGTVDIVLTPLVAEALDRYIEAMVHCASTRHPAAIVDDLHAKVLREAVQNSKTTFSENLSSKQDIRGTKTEQSTIGTTNQGQAQTNLTMKQDNVTIKGLQTNVSIPKVNLCLLQASVEESPTTAPSRSVTHVSLVALCFDRIATQVRMNRGVVEETSNNAEPGRTSNFDRYVHATKMQPQSSGSLRSNAGAEKGKEIAAKLNIHRVHGQLRGLDTTDIGTCAITAIPFEKSKVLFTLEELDEFTFVDETDQQAVPDVTRIGPSQEKWGWIMFECGLENLTIKGGRQSGAVLYNSFGIMGKASDTERGGVLTSNNSSDSPTGSGYNTDVSDDNLPCDRTSPSSDLNGNSVSDEQDEGVESDDLKKDLPLMPPPPDSCSMKLTIKEIWFSFAAPTNVRSHTHAFSRQLNLLSTATPAVGAWLVPIDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTFPEETELDLLSVTIEGPSHYSSNSEGSCSVFSSPKTPGGFSPGIPFQTEEGRRDDSLSSTSEDSEKDEKDEDHERERFYIYRKPSHTSRKKATGFAAVHQLFTERWPTTPVNRSLSGTATERNIDFELDIRVEIDSGKCVLHPTTLLQEHDDISLRRSYDRSSRSLDQDSPSKKKKFQTNYASTTHLMTGKKVPSSLQTKPSDLETTVFYIPGVDVKLHYNSKTLKTESPNASRGSSLPRTLSKESKLYGMKDSATSPPSPPLPSTVQSKTNTLLPPQPPPIPAAKGKGSGGVKTAKLYAWVALQSLPEEMVISPCLLDFLEKALETIPITPVERNYTAVSSQDEDMGHFEIPDPMEESTTSLVSSSTSAYSSFPVDVVVYVRVQPSQIKFSCLPVSRVECMLKLPSLDLVFSSNRGELETLGTTYPAETLSPGGNATQSGTKTSASKTGIPGSSGLGSPLGRSRHSSSQSDLTSSSSSSSGLSFTACMSDFSLYVFHPYGAGKQKTAVSGLTPGSGGLGNVDEEPTSVTGRKDSLSINLEFVKVSLSRIRRSGGASFFESQSVSKSASKMDTTLINISAVCDIGSASFKYDMRRLSEILAFPRAWYRRSIARRLFLGDQTINLPTSGPGTPDSIEGVSQHLSPESSRKAYCKTWEQPSQSASFTHMPQSPNVFNEHMTNSTMSPGTVGQSLKSPASIRSRSVSDSSVPRRDSLSKTSTPFNKSNKAASQQGTPWETLVVFAINLKQLNVQMNMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 59634 - protein, 428 aa, Homo sapiens
MGGLFSRWRTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 59635 - protein, 905 aa, Homo sapiens [sequence omitted]

SEQ ID NO: 59636 - protein, 789 aa, Homo sapiens
MLEGNYQVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLKVGAGVGAFTAVLLVALTCYFWKKNQKLEYKYSKLVMTTNSKECELPAADSCAIMEGEDNEEEVVYSNKQSLLGKLKSLATKEKEDHFESVQLKTSRSPNI

SEQ ID NO: 59637 - protein, 111 aa, Homo sapiens
MVRTKADSVPGTYRKVVAARAPRKVLGSSTSATNSTSVSSRKAENKYAGGNPVCVRPTPKWQKGIGEFFRLSPKDSEKENQIPEEAGSSGLGKAKRKACPLQPDHTNDEKE

SEQ ID NO: 59638 - protein, 923 aa, Homo sapiens
MSQFKRQRINPLPGGRNFSGTASTSLLGPPPGLLTPPVATELSQNARHLQGGEKQRVFTGIVTSLHDYFGVVDEEVFFQLSVVKGRLPQLGEKVLVKAAYNPGQAVPWNAVKVQTLSNQPLLKSPAPPLLHVAALGQKQGILGAQPQLIFQPHRIPPLFPQKPLSLFQTSHTLHLSHLNRFPARGPHGRLDQGRSDDYDSKKRKQRAGGEPWGAKKPRHDLPPYRVHLTPYTVDSPICDFLELQRRYRSLLVPSDFLSVHLSWLSAFPLSQPFSLHHPSRIQVSSEKEAAPDAGAEPITADSDPAYSSKVLLLSSPGLEELYRCCMLFVDDMAEPRETPEHPLKQIKFLLGRKEEEAVLVGGEWSPSLDGLDPQADPQVLVRTAIRCAQAQTGIDLSGCTKWWRFAEFQYLQPGPPRRLQTVVVYLPDVWTIMPTLEEWEALCQQKAAEAAPPTQEAQGETEPTEQAPDALEQAADTSRRNAETPEATTQQETDTDLPEAPPPPLEPAVIARPGCVNLSLHGIVEDRRPKERISFEVMVLAELFLEMLQRDFGYRVYKMLLSLPEKVVSPPEPEKEEAAKEEATKEEEAIKEEVVKEPKDEAQNEGPATESEAPLKEDGLLPKPLSSGGEEEEKPRGEASEDLCEMALDPELLLLRDDGEEEFAGAKLEDSEVRSVASNQSEMEFSSLQDMPKELDPSAVLPLDCLLAFVFFDANWCGYLHRRDLERILLTLGIRLSAEQAKQLVSRVVTQNICQYRSLQYSRQEGLDGGLPEEVLFGNLDLLPPPGKSTKPGAAPTEHKALVSHNGSLINVGSLLQRAEQQDSGRLYLENKIHTLELKLEESHNRFSATEVTNKTLAAEMQELRVRLAEAEETARTAERQKSQLQRLLQELRRRLTPLQLEIQRVVEKADSWVEKEEPAPSN

SEQ ID NO: 59639 - protein, 1159 aa, Homo sapiens
MLDFLAENNLCGQAILRIVSCGNAIIAELLRLSEFIPAVFRLKDRADQQKYGDIIFDFSYFKGPELWESKLDAKPELQDLDEEFRENNIEIVTRFYLAFQSVHKYIVDLNRYLDDLNEGVYIQQTLETVLLNEDGKQLLCEALYLYGVMLLVIDQKIEGEVRERMLVSYYRYSAARSSADSNMDDICKLLRSTGYSSQPGAKRPSNYPESYFQRVPINESFISMVIGRLRSDDIYNQVSAYPLPEHRSTALANQAAMLYVILYFEPSILHTHQAKMREIVDKYFPDNWVISIYMGITVNLVDAWEPYKAAKTALNNTLDLSNVREQASRYATVSERVHAQVQQFLKEGYLREEMVLDNIPKLLNCLRDCNVAIRWLMLHTADSACDPNNKRLRQIKDQILTDSRYNPRILFQLLLDTAQFEFILKEMFKQMLSEKQTKWEHYKKEGSERMTELADVFSGVKPLTRVEKNENLQAWFREISKQILSLNYDDSTAAGRKTVQLIQALEEVQEFHQLESNLQVCQFLADTRKFLHQMIRTINIKEEVLITMQIVGDLSFAWQLIDSFTSIMQESIRVNPSMVTKLRATFLKLASALDLPLLRINQANSPDLLSVSQYYSGELVSYVRKVLQIIPESMFTSLLKIIKLQTHDIIEVPTRLDKDKLRDYAQLGPRYEVAKLTHAISIFTEGILMMKTTLVGIIKVDPKQLLEDGIRKELVKRVAFALHRGLIFNPRAKPSELMPKLKELGATMDGFHRSFEYIQDYVNIYGLKIWQEEVSRIINYNVEQECNNFLRTKIQDWQSMYQSTHIPIPKFTPVDESVTFIGRLCREILRITDPKMTCHIDQLNTWYDMKTHQEVTSSRLFSEIQTTLGTFGLNGLDRLLCFMIVKELQNFLSMFQKIILRDRTVQDTLKTLMNAVSPLKSIVANSNKIYFSAIAKTQKIWTAYLEAIMKVGQMQILRQQIANELNYSCRFDSKHLAAALENLNKALLADIEAHYQDPSLPYPKEDNTLLYEITAYLEAAGIHNPLNKIYITTKRLPYFPIVNFLFLIAQLPKLQYNKNLGMVCRKPTDPVDWPPLVLGLLTLLKQFHSRYTEQFLALIGQFICSTVEQCTSQKIPEIPADVVGALLFLEDYVRYTKLPRRVAEAHVPNFIFDEFRTVL

SEQ ID NO: 59640 - protein, 807 aa, Homo sapiens
MFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEDQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHSVLSSQFLALCTLKPSLVVELARDLLEFLGSVNGLCSRASLVTSVVWAIGEYLSVTYDRRCTVEQINKFFEALEALLFEVTQCRPSAALPRCPPQVVTVLMTTLTKLASRSQDLIPRASLLLSKMRTLAHSPATSSTHSEEGAEAIRTRATELLTLLKMPSVAQFVLTPSTEVCSPRYHRDANTALPLALRTVSRLVEREAGLMPG

SEQ ID NO: 59641 - protein, 1361 aa, Homo sapiens; identical to SEQ ID NO: 59630

SEQ ID NO: 59642 - protein, 621 aa, Homo sapiens
MANVPWAEVCEKFQAALALSRVELHKNPEKEPYKSKYSARALLEEVKALLGPAPEDEDERPEAEDGPGAGDHALGLPAEVVEPEGPVAQRAVRLAVIEFHLGVNHIDTEELSAGEEHLVKCLRLLRRYRLSHDCISLCIQAQNNLGILWSEREEIETAQAYLESSEALYNQYMKEVGSPPLDPTERFLPEEEKLTEQERSKRFEKVYTHNLYYLAQVYQHLEMFEKAAHYCHSTLKRQLEHNAYHPIEWAINAATLSQFYINKLCFMEARHCLSAANVIFGQTGKISATEDTPEAEGEVPELYHQRKGEIARCWIKYCLTLMQNAQLSMQDNIGELDLDKQSELRALRKKELDEEESIRKKAVQFGTGELCDAISAVEEKVSYLRPLDFEEARELFLLGQHYVFEAKEFFQIDGYVTDHIEVVQDHSALFKVLAFFETDMERRCKMHKRRIAMLEPLTVDLNPQYYLLVNRQIQFEIAHAYYDMMDLKVAIADRLRDPDSHIVKKINNLNKSALKYYQLFLDSLRDPNKVFPEHIGEDVLRPAMLAKFRVARLYGKIITADPKKELENLATSLEHYKFIVDYCEKHPEAAQEIEVELELSKEMVSLLPTKMERFRTKMALT

SEQ ID NO: 59643 - protein, 1516 aa, Homo sapiens; identical to SEQ ID NO: 59629

SEQ ID NO: 59644 - protein, 1359 aa, Homo sapiens
MYSVEDLLISHGYKLSRDPPASREDNPKGRQAARTGTRAGQGLQNGHEDGPAALAHRKTSAGKGHVSDSESRRSTPRGHGEPQSTSASRTSEAGFCNQPPSAWSSHPPTGNDQAYRRRGRQEARSQKPREHENLEARGMAQAHSLPVHVREGPWEVGGRSEHVMKKPVWEEELRMSGPAKWQNVSLESWNQPRKLGRQMSDGDGERLFQDLYPFIQGEHVLNSQNKGKSRSLPRVLSPESLSCTEIPIPLNERHSPKMPPYPPTCAPNLDSTRNSEKSGCSAPFPRPKFGRPLKPPSYSSHQQSRGGADSSDSQDSQQMDAYVPRHELCLSDPGLEPPVYVPPPSYRSPPQNIPNPYLEDTVPINVCGGHSQQQSPTEKAGASGQPPSGPPGTGNEYGVSPRLPQGLPAHPRPVTAYDGFVQYIPFDDPRLRHFKLAQPQGFCEDIKLDDKSYNSSPVTAQEPAHGGMQPDGAIWNPQSLIPPSGDERGLVLADSSPRWLWGQPPGDGENSGLPNQRDRCVARGQWPDVRGSQHGHTGRQVSSPYSQGESTCETQTKLKKFQTGTRTKKSSKKKMNETIFCLVSIPVKSESHLPDRDMDNNDLKPSADQKNGSDKSPALQEQSLLSMSSTDLELQALTGSMGGRTEFQKQDLGEPEEDRQTNDLSFIHLTKHRELKHSGSWPGHRYRDQQTQTSFSEEPQSSQLLPGAKLGGPSRAALSPKCSDPAASEAQTHTAFPTGDHKQRPSARNLKGHRSLSPSSNSAFSRTSLSVDQAPTPKAGRSQPCVDVHGLGAHPGPKREVVKGEPTGPCNSKQLFGQFLLKPVSRRPWDLISQLESFNKELQEEEESSSSSSSSSSSSEESEAEPQQENRAHCRQEDVGFRGNSPEMRVEPQPRMWVPESPVCRSGRGESKSESWSEELQPGHPRAWPPSPGRFRVEEGGGAPFCSADGSTSAEKRHLEVSNGMDELAGSPFPVTRMSSRSSDAKPLPASYPAEPREPQESPKITSAFSSVKPSEAVPRKFDSGGERGAGLPLSLSNKNRGLSAPDLRSVGLTPGQEQGASELEGSLGEASTIEIPPGESLQARAARILGIEVAVESLLPGIRRAGQNQPAEPDASACTPESPQEELLSRPAPADVPRVSTDAFYGRRKCGWTKSPLFVGDRDSARRAPQAFEHSDVDGVVTSTDPVPEPEPSPLESKFFEQKDVETKPPFRSTLFHFVERTPSVAGSEKRLRSPSKVIESLQEKLASPPRRADPDRLMRMKEVSSVSRMRVLSFRNADSQEDAEELKATTRGQAGLPGGLVSPGSGDRAQRLGHSLSVSKDSISREEKEHPAAQKEKSMDQDFWCPDSYDPSRVERV

SEQ ID NO: 59645 - protein, 1072 aa, Homo sapiens
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 59646 - protein, 305 aa, Homo sapiens
SQLPVRAEERTESCLWGCWASSRVRRTSDACSSPLATSRSARSCGVLTAPVKGASSSLVVKLADTDRERALRRMQQMAGHLGAFHPAPLPLGACGAYTTAILQHQAALLAAAQGPGLGPVAAVAAQMQHVAAFSLVAAPLLPAAAANSPPGSGPGTLPGLPAPIGVNGFGPLTPQTNGQPGSDTLYNNGLSPYPAQSPGVADPLQQAYAGMHHYAGPEGCNLFIYHLPQEFGDAELIQTFLPFGAVVSAKVFVDRATNQSKCFGFVSFDNPTSAQTAIQAMNGFQIGMKRLKVQLKRPKDANRPY

SEQ ID NO: 59647 - protein, 65 aa, Homo sapiens
MVRTKADSVPGTYRKVVAARAPRKVLGSSTSATNSTSVSSRKEHVLCNLITQMMKKNRTFSFIFE

SEQ ID NO: 59648 - protein, 5005 aa, Homo sapiens; identical to SEQ ID NO: 59633

SEQ ID NO: 59649 - protein, 923 aa, Homo sapiens; identical to SEQ ID NO: 59638

SEQ ID NO: 59650 - protein, 993 aa, Homo sapiens
MGAAGRQDFLFKAMLTISWLTLTCFPGATSTVAAGCPDQSPELQPWNPGHDQDHHVHIGQGKTLLLTSSATVYSIHISEGGKLVIKDHDEPIVLRTRHILIDNGGELHAGSALCPFQGNFTIILYGRADEGIQPDPYYGLKYIGVGKGGALELHGQKKLSWTFLNKTLHPGGMAEGGYFFERSWGHRGVIVHVIDPKSGTVIHSDRFDTYRSKKESERLVQYLNAVPDGRILSVAVNDEGSRNLDDMARKAMTKLGSKHFLHLGFRHPWSFLTVKGNPSSSVEDHIEYHGHRGSAAARVFKLFQTEHGEYFNVSLSSEWVQDVEWTEWFDHDKVSQTKGGEKISDLWKAHPGKICNRPIDIQATTMDGVNLSTEVVYKKGQDYRFACYDRGRACRSYRVRFLCGKPVRPKLTVTIDTNVNSTILNLEDNVQSWKPGDTLVIASTDYSMYQAEEFQVLPCRSCAPNQVKVAGKPMYLHIGEEIDGVDMRAEVGLLSRNIIVMGEMEDKCYPYRNHICNFFDFDTFGGHIKFALGFKAAHLEGTELKHMGQQLVGQYPIHFHLAGDVDERGGYDPPTYIRDLSIHHTFSRCVTVHGSNGLLIKDVVGYNSLGHCFFTEDGPEERNTFDHCLGLLVKSGTLLPSDRDSKMCKMITEDSYPGYIPKPRQDCNAVSTFWMANPNNNLINCAAAGSEETGFWFIFHHVPTGPSVGMYSPGYSEHIPLGKFYNNRAHSNYRAGMIIDNGVKTTEASAKDKRPFLSIISARYSPHQDADPLKPREPAIIRHFIAYKNQDHGAWLRGGDVWLDSCRFADNGIGLTLASGGTFPYDDGSKQEIKNSLFVGESGNVGTEMMDNRIWGPGGLDHSGRTLPIGQNFPIRGIQLYDGPINIQNCTFRKFVALEGRHTSALAFRLNNAWQSCPHNNVTGIAFEDVPITSRVFFGEPGPWFNQLDMDGDKTSVFHDVDGSVSEYPGSYLTKNDNKWHSLASKAASGPSG

SEQ ID NO: 59651 - protein, 1361 aa, Homo sapiens; identical to SEQ ID NO: 59630

SEQ ID NO: 59652 - protein, 648 aa, Homo sapiens
MEVKGKKQFTGKSTKTAQEKNRFHKNSDSGSSKTFPTRKVAKEGGPKVTSRNFEKSITKLGKKGVKQFKNKQQGDKSPKNKFQPANKFNKKRKFQPDGRSDESAAKKPKWDDFKKKKKELKQSRQLSDKTNYDIVVRAKQMWEILRRKDCDKEKRVKLMSDLQKLIQGKIKTIAFAHDSTRVIQCYIQYGNEEQRKQAFEELRDDLVELSKAKYSRNIVKKFLMYGSKPQIAEIIRSFKGHVRKMLRHAEASAIVEYAYNDKAILEQRNMLTEELYGNTFQLYKSADHRTLDKVLEVQPEKLELIMDEMKQILTPMAQKEAVIKHSLVHKVFLDFFTYAPPKLRSEMIEAIREAVVYLAHTHDGARVAMHCLWHGTPKDRKVIVKTMKTYVEKVANGQYSHLVLLAAFDCIDDTKLVKQIIISEIISSLPSIVNDKYGRKVLLYLLSPRDPAHTVREIIEVLQKGDGNAHSKKDTEVRRRELLESISPALLSYLQEHAQEVVLDKSACVLVSDILGSATGDVQPTMNAIASLAATGLHPGGKDGELHIAEHPAGHLVLKWLIEQDKKMKENGREGCFAKTLVEHVGMKNLKSWASVNRGAIILSSLLQSCDLEVANKVKAALKSLIPTLEKTKSTSKGIEILLEKLST

SEQ ID NO: 59653 - protein, 112 aa, Homo sapiens
MKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQE

SEQ ID NO: 59654 - protein, 613 aa, Homo sapiens
MFSAGAESLLHQAREIQDEELKKFCSRICKLLQAEDLGPDTLDSLQRLFLIISATKYSRRLEKTCVDLLQATLGLPACPEQLQVLCAAILREMSPSDSLSLAWDHTQNSRQLSLVASVLLAQGDRNEEVRAVGQGVLRALESRQPEGPSLRHLLPVMAKVVVLSPGTLQEDQATLLSKRLVDWLRYASLQQGLPHSGGFFSTPRARQPGPVTEVDGAVATDFFTVLSSGHRFTDDQWLNVQAFSMLRAWLLHSGPEGPGTLDTDDRSEQEGSTLSVISATSSAGRLLPPRERLREVAFEYCQRLIEQSNRRALRKGDSDLQKACLVEAVLVLDVLCRQDPSFLYRSLSCLKALHGRVRGDPASVRVLLPLAHFFLSHGEAAAVDSEAVYQHLFTRIPVEQFHSPMLAFEFIQFCRDNLHLFSGHLSTLRLSFPNLFKFLAWNSPPLTSEFVALLPALVDAGTALEMLHALLDLPCLTAVLDLQLRSAPAASERPLWDTSLRAPSCLEAFRDPQFQGLFQYLLRPKASGATERLAPLHQLLQPMAGCARVAQCAQAVPTLLQAFFSAVTQVADGSLINQLALLLLGRSDSLYPAPGYAAGVHRPDACRPILVPL

SEQ ID NO: 59655 - protein, 305 aa, Homo sapiens
MEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 59656 - protein, 862 aa, Homo sapiens
MHSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLKVGAGVGAFTAVLLVALTCYFWKKNQKLEYKYSKLVMTTNSKECELPAADSCAIMEGEDNEEEVVYSNKQSLLGKLKSLATKEKEDHFESVQLKTSRSPNI

SEQ ID NO: 59657 - protein, 1950 aa, Homo sapiens
MPGARRRRRGAAMEGKPRAGVALAPGPSGRRPSARCARRRRPGLLLPGLWLLLLARPASCAPDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGIVPTPGRNLVLYPTDAYSHLSSRTLPEIVASLTEGVETTLFLSSRSLMPQPLGDGITIPLPSLGEVSQPPEEVWATSADRYTDVTTVLSQSLEETISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSSFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREATHMLGHQEYSSSPLFQVPRTSGREPSAPSGNLPHRGLQGPGLGYPTSSTEDLQPGHSSASLIKAIREELLRLSQKQSTVQNFHS

SEQ ID NO: 59658 - protein, 118 aa, Homo sapiens
  MOD_RES (1)..(1): Any amino acid
XKSNGKTAIGDPGRANMPGYNEDSRSTFFDKKYSNMSTLGNNGPTHKKLYRHKSSSKALRDEKCKGKHMEREQVHKDESGTASFEKLRDSDYNLLKAETTFWVLPVFEEETRIFQKDI

SEQ ID NO: 59659 - protein, 1027 aa, Homo sapiens
MRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 59660 - protein, 606 aa, Homo sapiens
MGNTCRVCYQLEAIKRSNEMSNVMGNTTWTTSGLKSQGRLSVGSNRDREISMSVGLGRSQLDSKGGVVGGTIDVNALEMVAHISEHPNQQPSHKIQITMGSTEARVDYMGSSILMGIFSNADLKLQDEWKVNLYNTLDSSITDKSEIFVHGDLKWDIFQVMISRSTTPDLIKIGMKLQEFFTQQFDTSKRALSTWGPVPYLPPKTMTSNLEKSSQEQLLDAAHHRHWPGVLKVVSGCHISLFQIPLPEDGMQFGGSMSLHGNHMTLACFHGPNFRSKSWALFHLEEPNIAFWTEAQKIWEDGSSDHSTYIVQTLDFHLGHNTMVTKPCGALESPMATITKITRRRHENPPHGVASVKEWFNYVTATRNEELNLLRNVDANNTENSTTVKNSSLLSGFRGGSSYNHETETIFALPRMQLDFKSIHVQEPQEPSLQDASLKPKVECSVVTEFTDHICVTMDAELIMFLHDLVSAYLKEKEKAIFPPRILSTRPGQKSPIIIHDDNSSDKDREDSITYTTVDWRDFMCNTWHLEPTLRLISWTGRKIDPVGVDYILQKLGFHHARTTIPKWLQRGVMDPLDKVLSVLIKKLGTALQDEKEKKGKDKEEH

SEQ ID NO: 59661 - protein, 1934 aa, Homo sapiens
MPGARRRRRGAAMEGKPRAGVALAPGPSGRRPSARCARRRRPGLLLPGLWLLLLARPASCAPDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGIVPTPGRNLVLYPTDAYSHLSSRTLPEIVASLTEGVETTLFLSSRSLMPQPLGDGITIPLPSLGEVSQPPEEVWATSADRYTDVTTVLSQSLEETISPRTYPTVTASHAALAFSRTHSPLLSTPLAFASSASPTDVSSNPFLPSDSSKTSELHSNSALPGPVDNTHILSPVSSFRPYTWCAACTVPSPQQVLATSLMEKDVGSGDGAETLCMTVLEESSISLMSSVVADFSEFEEDPQVFNTLFPSRPIVPLSSRSMEISETSVGISAEVDMSSVTTTQVPPAHGRLSVPASLDPTAGSLSVAETQVTPSSVTTAFFSVITSILLDSSFSVIANKNTPSLAVRDPSVFTPYSLVPSVESSLFSDQERSSFSEHKPRGALDFASSFFSTPPLELSGSISSPSEAPASLSLMPSDLSPFTSQSFSPLVETFTLFDSSDLQSSQLSLPSSTNLEFSQLQPSSELPLNTIMLLPSRSEVSPWSSFPSDSLEFVEASTVSLTDSEAHFTSAFIETTSYLESSLISHESAVTALVPPGSESFDILTAGIQATSPLTTVHTTPILTESSLFSTLTPPDDQISALDGHVSVLASFSKAIPTGTVLITDAYLPSGSSFVSEATPFPLPTELTVVGPSLTPTEVPLNTSTEVSTTSTGAATGGPLDSTLMGDAASQSPPESSAAPPLPSLRPVTAFTLEATVDTPTLATAKPPYVCDITVPDAYLITTVLARRAVQEYIITAIKEVLRIHFNRAVELKVYELFTDFTFLVTSGPFVYTAISVINVLINSKLVRDQTPLILSVKPSFLVPESRFQVQTVLQFVPPSVDTGFCNFTQRIEKGLMTALFEVRKHHQGTYNLTVQILNITISSSRVTPRRGPVNIIFAVKSTQGFLNGSEVSELLRNLSVVEFSFYLGYPVLQIAEPFQYPQLNLSQLLKSSWVRTVLLGVMEKQLQNEVFQAEMERKLAQLLSEVSTRRRMWRRATVAAGNSVVQVVNVSRLEGDDNPVQLIYFVEDQDGERLSAVKSSDLINKMDLQRAAIILGYRIQGVIAQPVDRVKRPSPESQSNNLWVIVGVVIPVLVVMVIVVILYWKLCRTDKLDFQPDTVANIQQRQKLQIPSVKGFDFAKQHLGQHNKDDILIIHEPAPLPGPLKDHTTPSENGDVPSPKSKIPSKNVRHRGRVSPSDADSTVSEESSERDAGDKTPGAVNDGRSHRAPQSGPPLPSSGNEQHSSASIFEHVDRISRPPEASRRVPSKIQLIAMQPIPAPPVQRPSPADRVAESNKINKEIQTALRHKSEIEHHRNKIRLRAKRRGHYEFPVVDDLSSGDTKERHRVYRRAQMQIDKILDPTASVPSVFIEPRKSSRIKRSPKPRRKHQVNGCPADAEKDRLITTDSDGTYRRPPGVHNSAYIGCPSDPDLPADVQTPSSVELGRYPALPFPASQYIPPQPSIEEARQTMHSLLDDAFALVAPSSQPASTAGVGPGVPPGLPANSTPSQEERRATQWGSFYSPAQTANNPCSRYEDYGMTPPTGPLPRPGFGPGLLQSTELVPPDPQQPQASAEAPFAARGIYSEEMPSVARPRPVGGTTGSQIQHLTQVGIASRIGAQPVEIPPSRGSQYGGPGWPSYGEDEAGRREAVPRTSGREPSAPSGNLPHRGLQGPGLGYPTSSTEDLQPGHSSASLIKAIREELLRLSQKQSTVQNFHS

SEQ ID NO: 59662 - protein, 83 aa, Homo sapiens
MGGLFSRWRTKPSTVEVLESIDKEIQALEEFREKNQRLQKLWVGRLILYSSVLYLFTCLIVYLWYLPDEFTARLAMTLPFFAF

SEQ ID NO: 59663 - protein, 1029 aa, Homo sapiens
MLFRARGPVRGRGWGRPAEAPRRGRSPPWSPAWICCWALAGCQAAWAGDLPSSSSRPLPPCQEKDYHFEYTECDSSGSRWRVAIPNSAVDCSGLPDPVRGKECTFSCASGEYLEMKNQVCSKCGEGTYSLGSGIKFDEWDELPAGFSNIATFMDTVVGPSDSRPDGCNNSSWIPRGNYIESNRDDCTVSLIYAVHLKKSGYVFFEYQYVDNNIFFEFFIQNDQCQEMDTTTDKWVKLTDNGEWGSHSVMLKSGTNILYWRTTGILMGSKAVKPVLVKNITIEGVAYTSECFPCKPGTFSNKPGSFNCQVCPRNTYSEKGAKECIRCKDDSQFSEEGSSECTERPPCTTKDYFQIHTPCDEEGKTQIMYKWIEPKICREDLTDAIRLPPSGEKKDCPPCNPGFYNNGSSSCHPCPPGTFSDGTKECRPCPAGTEPALGFEYKWWNVLPGNMKTSCFNVGNSKCDGMNGWEVAGDHIQSGAGGSDNDYLILNLHIPGFKPPTSMTGATGSELGRITFVFETLCSADCVLYFMVDINRKSTNVVESWGGTKEKQAYTHIIFKNATFTFTWAFQRTNQGQDNRRFINDMVKIYSITATNAVDGVASSCRACALGSEQSGSSCVPCPPGHYIEKETNQCKECPPDTYLSIHQVYGKEACIPCGPGSKNNQDHSVCYSDCFFYHEKENQSLHYDFSNLSSVGSLMNGPSFTSKGTKYFHFFNISLCGHEGKKMALCTNNITDFTVKEIVAGSDDYTNLVGAFVCQSTIIPSESKGFRAALSSQSIILADTFIGVTVETTLKNINIKEDMFPVPTSQIPDVHFFYKSSTATTSCINGRSTAVKMRCNPTKSGAGVISVPSKCPAGTCDGCTFYFLWESAEACPLCTEHDFHEIEGACKRGFQETLYVWNEPKWCIKGISLPEKKLATCETVDFWLKVGAGVGAFTAVLLVALTCYFWKKNQKLEYKYSKLVMTTNSKECELPAADSCAIMEGEDNEEEVVYSNKQSLLGKLKSLATKEKEDHFESVQLKTSRSPNI

SEQ ID NO: 59664 - protein, 3680 aa, Homo sapiens
MDQRKNESIVPSITQLEDFLTEHNSNVVWLLVATILSCGWIIYLTYYNSRNVGLILTLVLNRLYKHGYIHIGSFSFSVLSGKVMVREIYYITEDMSIRIQDGFIIFRWWKMYNPKQKQHDPKAETRLYITVNDFEFHVYNRSDLYGRLQELFGLEPTIIPPKKDDDKTREIGRTRTQSKIERVKVKTESQDPTSSWRSLIPVIKVNVSTGRLAFGNHYQPQTLCINFDDAFLTYTTKPPSSHLDQFMHIVKGKLENVRVMLVPSPRYVGLQNDEPPRLMGEGFVVMQSNDVDIYYYMDEPGLVPEETEENIEGEMSSEDCKLQDLPPCWGLDIVCGKGTDFNYGPWADRQRDCLWKFFFPPDYQVLKVSEIAQPGRPRQILAFELRMNIIADATIDLLFTKNRETNAVHVNVGAGSYLEINIPMTVEENGYTPAIKGQLLHVDATTSMQYRTLLEAEMLAFHINASYPRIWNMPQTWQCELEVYKATYHFIFAQKNFFTDLIQDWSSDSPPDIFSFVPYTWNFKIMFHQFEMIWAANQHNWIDCSTKQQENVYLAACGETLNIDFSLPFTDFVPATCNTKFSLRGEDVDLHLFLPDCHPSKYSLFMLVKNCHPNKMIHDTGIPAECQSGQKTVKPKWRNVTQEKSGWVECWTVPSVMLTIDYTWHPIYPQKADEQLKQSLSEMEETMLSVLRPSQKTSDRVVSSPSTSSRPPIDPSELPPDKLHVEMELSPDSQITLYGPLLNAFLCIKENYFGEDDMYMDFEEVISSPVLSLSTSSSSGWTAVGMENDKKENEGSAKSIHPLALRPWDITVLVNLYKVHGRLPVHGTTDGPECPTAFLERLCFEMKKGFRETMLQLILSPLNVFVSDNYQQRPPVDEVLREGHINLSGLQLRAHAMFSAEGLPLGSDSLEYAWLIDVQAGSLTAKVTAPQLACLLEWGQTFVFHVVCREYELERPKSVIICQHGIDRRFCESKLSCIPGPCPTSDDLKYTMIRLAVDGADIYIVEHGCATNIKMGAIRVANCNLHNQSVGEGISAAIQDFQVRQYIEQLNNCRIGLQPAVLRRAYWLEAGSANLGLITVDIALAADHHSKHEAQRHFLETHDARTKRLWFLWPDDILKNKRCRNKCGCLGGCRFFGGTVTGLDFFKLEELTPSSSSAFSSTSAESDMYYGQSLLQPGEWIITKEIPKIIDGNVNGMKRKEWENKSVGIEVERKTQHLSLQVPLRSHSSSSSSEENSSSSAAQPLLAGEKESPSSVADDHLVQKEFLHGTKRDDGQASIPTEISGNSPVSPNTQDKSVGQSPLRSPLKRQASVCSTRLGSTKSLTAAFYGDKQPVTVGVQFSSDVSRSDENVLDSPKQRRSFGSFPYTPSADSNSFHQYRSMDSSMSMADSEAYFSAAEEFEPISSDEGPGTYPGRKKKKKQTQQIDYSRGSIYHSVEGPLTGHGESIQDSRTLPFKTHPSQASFVSALGGEDDVIEHLYIVEGEKTVESEQITPQQPVMNCYQTYLTQFQVINWSVKHPTNKRTSKSSLHRPLDLDTPTSEESSSSFEQLSVPTFKVIKQGLTANSLLDRGMQLSGSTSNTPYTPLEKKLADNTDDETLTEEWTLDQPVSQTRTTAIVEVKGTVDIVLTPLVAEALDRYIEAMVHCASTRHPAAIVDDLHAKVLREAVQNSKTTFSENLSSKQDIRGTKTEQSTIGTTNQGQAQTNLTMKQDNVTIKGLQTNVSIPKVNLCLLQASVEESPTTAPSRSVTHVSLVALCFDRIATQVRMNRGVVEETSNNAEPGRTSNFDRYVHATKMQPQSSGSLRSNAGAEKGKEIAAKLNIHRVHGQLRGLDTTDIGTCAITAIPFEKSKVLFTLEELDEFTFVDETDQQAVPDVTRIGPSQEKWGWIMFECGLENLTIKGGRQSGAVLYNSFGIMGKASDTERGGVLTSNNSSDSPTGSGYNTDVSDDNLPCDRTSPSSDLNGNSVSDEQDEGVESDDLKKDLPLMPPPPDSCSMKLTIKEIWFSFAAPTNVRSHTHAFSRQLNLLSTATPAVGAWLVPIDQLKSSLNKLETEGTLRICAVMGCIMTEALENKSVHFPLRSKYNRLTKVARFLQENPSCLLCNILHHYLHQANYSIIDDATMSDGLPALVTLKKGLVALARQWMKFIVVTPAFKGVSLHRPAQPLKPQIAMDHEHEDGLGLDNGGGLQSDTSADGAEFEFDAATVSEHTMLLEGTANRPPPGSSGPVTGAEIMRKLSKTHTHSDSALKIKGIHPYHSLSYTSGDTATDSPVHVGRAGMPVKDSPRKESLLSYLTGSFPSLHNLLEGTPQRSSAAVKSSSLTRTGNTVATDMLSEHPLLSEPSSVSFYNWMSNAVGNRGSVLQESPVTKSGHNSLPTGVAPNLPTIPSASDFNTVLSSDQNTLDGTHSQHSTSQDDVAGVEEANQGFPAVQLADAQVVFKPLLSHTGIQSQDTMPFCYRMYFGEHLSFSGTLDCLRADIVDSDTAKERKGKRARRQGHVNLPPLEFKPALMLGTFSISAVVMEKSVCTPQNSTSALSFHDLSKRYYNTFHCNFTISCQSISQHVDMALVRLIHQFSTMIDDIKATQTDIKLSRYTAGSASPTPTFKTRKHRDFRSSDFSRSSRGSLNGGNRVNNAKNKRTNNENNKKESRNKNSLGRSERRTSKVSRKGSKDVVDHMTIHMDDSDSITVSEQSEPSAECWQNMYKLLNFYSLISDPTGILEKSSETFGPAGVRSPTEPTCKVVFENEQDNSSLTKTQRKRSLVTSEPQHVTLIVFGIGMVNRTHLEADIGGLTMESELKRIHGSFTLKEKMKDVLHQKMTETCATAHIGGVNIVLLEGITPNIQLEDFPTSPTSTAKQEFLTVVKCSIAKSQALYSAQRGLKTNNAAVFKVGAISINIPQHPATLHSMMVRSSHQLSKQISDLIRQPSTAPQPVKEDIATPLPSEKTPTSVNQTPVETNEFPQLPEGLEKKPIVLKFSAMLDGIAIGAALLPSLKAEYKMGRMRSHGMTGAQTRFTFELPNHRLRFTSKVSATDMSTIPPSASLNLPPVTMSGKYIMEEHDSYSDQVWSIDELPSKQGYYLQGNYLRCVAEVGSFEHNLTTDLLNHLVFVQKVFMKEVNEVIQKVSGGEQPIPLWNEHDGTADGDKPKILLYSLNLQFKGIQVTATTPSMRAVRFETGLIELELSNRLQTKASPGSSSYLKLFGKCQVDLNLALGQIVKHQVYEEAGSDFHQVAYFKTRIGLRNALREEISGSSDREAVLITLNRPIVYAQPVAFDRAVLFWLNYKAAYDNWNEQRMALHKDIHMATKEVVDMLPGIQQTSAQAFGTLFLQLTVNDLGICLPITNTAQSNHTGDLDTGSALVLTIESTLITACSSESLVSKGHFKNFCIRFADGFETSWDDWKPEIHGDLVMNACVVPDGTYEVCSRTTGQAAAESSSAGTWTLNVLWKMCGIDVHMDPNIGKRLNALGNTLTTLTGEEDIDDIADLNSVNIADLSDEDEVDTMSPTIHTEATDYRRQAASASQPGELRGRKIMKRIVDIRELNEQAKVIDDLKKLGASEGTINQEIQRYQQLESVAVNDIRRDVRKKLRRSSMRAASLKDKWGLSYKPSYSRSKSISASGRPPLKRMERASSRVGETEELPEIRVDAASPGPRVTFNIQDTIAEIRRKKISFKVVF

SEQ ID NO: 59665 - protein, 746 aa, Homo sapiens
MPCLGLLANLCRHNLSVQTHIKTLSNVKSFYRTLITLLAHSSLTVVVFALSILSSLTLNEEVGEKLFHARNIHQTFQLIFNILINGDGTLTRKYSVDLLMDLLKNPKIADYLTRYEHFSSCLHQVLGLLNGKDPDSSSKVLELLLAFCSVTQLRHMLTQMMFEQSPPGSATLGSHTKCLEPTVALLRWLSQPLDGSENCSVLALELFKEIFEDVIDAANCSSADRFVTLLLPTILDQLQFTEQNLDEALTRKKCERIAKAIEVLLTLCGDDTLKMHIAKILTTVKCTTLIEQQFTYGKIDLGFGTKVADSELCKLAADVILKTLDLINKLKPLVPGMEVSFYKILQDPRLITPLAFALTSDNREQVQSGLRILLEAAPLPDFPALVLGESIAANNAYRQQETEHIPRKMPWQSSNHSFPTSIKCLTPHLKDGVPGLNIEELIEKLQSGMVVKDQICDVRISDIMDVYEMKLSTLASKESRLQDLLETKALALAQADRLIAQHRCQRTQAETEARTLASMLREVERKNEELSVLLKAQQVESERAQSDIEHLFQHNRKLESVAEEHEILTKSYMELLQRNESTEKKNKDLQITCDSLNKQIETVKKLNESLKEQNEKSIAQLIEKEEQRKEVQNQLVDREHKLANLHQKTKVQEEKIKTLQKEREDKEETIDILRKELSRTEQIRKELSIKASSLEVQKAQLEGRLEEKESLVKLQQEELNKHSHMIAMIHSLSGGKINPETVNLSI

SEQ ID NO: 59666 - protein, 279 aa, Homo sapiens
MTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEVQY

SEQ ID NO: 59667 - protein, 1063 aa, Homo sapiens
MTRLGWPSPCCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCEWSIFYVTVLAFTLIVLTGGFTWLCICCCKRQKRTKIRKKTKYTILDNMDEQERMELRPKYGIKHRSTEHNSSLMVSESEFDSDQDTIFSREKMERGNPKVSMNGSIRNGASFSYCSKDR

SEQ ID NO: 59668 - protein, 430 aa, Homo sapiens
MGRSWPGLSLCQWRLLPALEAGWAVAAETGGGGRPGRAAPASCSCEFLWTIDDIYHCAQFLQIKDGWIIFSMEARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 59669 - protein, 1011 aa, Homo sapiens
MAPPTGVLSSLLLLVTIAGCARKQCSEGRTYSNAVISPNLETTRIMRVSHTFPVVDCTAACCDLSSCDLAWWFEGRCYLVSCPHKENCEPKKMGPIRSYLTFVLRPVQRPAQLLDYGDMMLNRGSPSGIWGDSPEDIRKDLTFLGKDWGLEEMSEYSDDYRELEKDLLQPSGKQEPRGSAEYTDWGLLPGSEGAFNSSVGDSPAVPAETQQDPELHYLNESASTPAPKLPERSVLLPLPTTPSSGEVLEKEKASQLQEQSSNSSGKEVLMPSHSLPPASLELSSVTVEKSPVLTVTPGSTEHSIPTPPTSAAPSESTPSELPISPTTAPRTVKELTVSAGDNLIITLPDNEVELKAFVAPAPPVETTYNYEWNLISHPTDYQGEIKQGHKQTLNLSQLSVGLYVFKVTVSSENAFGEGFVNVTVKPARRVNLPPVAVVSPQLQELTLPLTSALIDGSQSTDDTEIVSYHWEEINGPFIEEKTSVDSPVLRLSNLDPGNYSFRLTVTDSDGATNSTTAALIVNNAVDYPPVANAGPNHTITLPQNSITLNGNQSSDDHQIVLYEWSLGPGSEGKHVVMQGVQTPYLHLSAMQEGDYTFQLKVTDSSRQQSTAVVTVIVQPENNRPPVAVAGPDKELIFPVESATLDGSSSSDDHGIVFYHWEHVRGPSAVEMENIDKAIATVTGLQVGTYHFRLTVKDQQGLSSTSTLTVAVKKENNSPPRARAGGRHVLVLPNNSITLDGSRSTDDQRIVSYLWIRDGQSPAAGDVIDGSDHSVALQLTNLVEGVYTFHLRVTDSQGASDTDTATVEVQPDPRKSGLVELTLQVGVGQLTEQRKDTLVRQLAVLLNVLDSDIKVQKIRAHSDLSTVIVFYVQSRPPFKVLKAAEVARNLHMRLSKEKADFLLFKVLRVDTAGCLLKCSGHGHCDPLTKRCICSHLWMENLIQRYIWDGESNCGIKHRSTEHNSSLMVSESEFDSDQDTIFSREKMERGNPKVSMNGSIRNGASFSYCSKDR

SEQ ID NO: 59670 - protein, 401 aa, Homo sapiens
METPEVPVGSLIDFGPEAPTSSPLEAPPPVLQDGDGSLGDGASESETTESADSENDMGESPSHPSWDQDRRSSSNESFSSNQSTESTQDEETLALRDFMRGYVEKIFSGGEDLDQEEKAKFGEYCSSENGKGREWFARYVSAQRCNSKCVSEATFYRLVQSFAVVLFECHQMDDFGPAKNLMTMCFTYYHIGKPQLLPPESREKPAGSIDSYLKSANSWLAEKKDIAERLLKNTSARTENVKGFFGGLETKLKGPLARRNEEDENKPQEKRPRAVTAYSPEDEKKGEKIYLYTHLKQQPIWHTLRFWNAAFFDAVHCERTKRSPTTREKWCHMTQEERDDSLRFNENITFGQLGTFTHNMLAFGLNKKLCNDFLKKQAVIGNLDEEQYKLLSDHIEQMATE

SEQ ID NO: 59671 - protein, 1072 aa, Homo sapiens; identical to SEQ ID NO: 59645

SEQ ID NO: 59672 - protein, 459 aa, Homo sapiens
MGGLFSRWRTKPSTVEVLESIDKEIQALEEFREKNQRLQKLWVGRLILYSSVLYLFTCLIVYLWYLPDEFTARLAMTLPFFAFPLIIWSIRTVIIFFFSKRTERNNEALDDLKSQRKKILEEVMEKETYKTAKLILERFDPDSKKAKECEPPSAGAAVTARPGQEIRQRTAAQRNLSPTPASPNQGPPPQVPVSPGPPKDSSAPGGPPERTVTPALSSNVLPRHLGSPATSVPGMEMGLPHIAQAGLEHLSSSDLSTSTSQSAGITGLHPPGPPLARPILPRERGALDRIVEYLVGDGPQNRYALICQQCFSHNGMALKEEFEYIAFRCAYCFFLNPARKTRPQAPRLPEFSFEKRQVVEGSSSVGPLPSGSVLSSDNQFNEESLEHDVLDDNTEQTDDKIPATEQTNQVIEKASDSEEPEEKQETENEEASVIETNSTVPGADSIPDPELSGESLTAE

SEQ ID NO: 59673 - protein, 525 aa, Homo sapiens
MSRQLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 59674 - protein, 522 aa, Homo sapiens
MSRQLLPVLLLLLLRASCPWGQEQGARSPSEEPPEEEIPKEDGILVLSRHTLGLALREHPALLVEFYAPWCGHCQALAPEYSKAAAVLAAESMVVTLAKVDGPAQRELAEEFGVTEYPTLKFFRNGNRTHPEEYTGPRDAEGIAEWLRRRVGPSAMRLEDEAAAQALIGGRDLVVIGFFQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 59675 - protein, 494 aa, Homo sapiens
MGSGTGSEEPLGGASRGGNPQGGWDLGAEPPHPGPGPAGAPCPAGGILCPVVWALPGPGPRVQQGSCRARGRVNGGHAEEFGVTEYPTLKFFRNGNRTHPEEYTGPRDAEGIAEWLRRRVGPSAMRLEDEAAAQALIGGRDLVVIGFFQDLQDEDVATFLALAQDALDMTFGLTDRPRLFQQFGLTKDTVVLFKKFDEGRADFPVDEELGLDLGDLSRFLVTHSMRLVTEFNSQTSAKIFAARILNHLLLFVNQTLAAHRELLAGFGEAAPRFRGQVLFVVVDVAADNEHVLQYFGLKAEAAPTLRLVNLETTKKYAPVDGGPVTAASITAFCHAVLNGQVKPYLLSQEIPPDWDQRPVKTLVGKNFEQVAFDETKNVFVKFYAPWCTHCKEMAPAWEALAEKYQDHEDIIIAELDATANELDAFAVHGFPTLKYFPAGPGRKVIEYKSTRDLETFSKFLDNGGVLPTEEPPEEPAAPFPEPPANSTMGSKEEL

SEQ ID NO: 59676 - protein, 440 aa, Homo sapiens
MALLVLGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 59677 - protein, 445 aa, Homo sapiens
MYPSTTMANAPGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 59678 - protein, 11 aa, Homo sapiens
MYPSTTMANAP

SEQ ID NO: 59679 - protein, 437 aa, Homo sapiens
MILGLVSCTFFLAVNGLYSSSDDVIELTPSNFNREVIQSDSLWLVEFYAPWCGHCQRLTPEWKKAATALKDVVKVGAVDADKHHSLGGQYGVQGFPTIKIFGSNKNRPEDYQGGRTGEAIVDAALSALRQLVKDRLGGRSGGYSSGKQGRSDSSSKKDVIELTDDSFDKNVLDSEDVWMVEFYAPWCGHCKNLEPEWAAAASEVKEQTKGKVKLAAVDATVNQVLASRYGIRGFPTIKIFQKGESPVDYDGGRTRSDIVSRALDLFSDNAPPPELLEIINEDIAKRTCEEHQLCVVAVLPHILDTGAAGRNSYLEVLLKLADKYKKKMWGWLWTEAGAQSELETALGIGGFGYPAMAAINARKMKFALLKGSFSEQGINEFLRELSFGRGSTAPVGGGAFPTIVEREPWDGRDGELPVEDDIDLSDVELDDLGKDEL

SEQ ID NO: 59680 - protein, 651 aa, Homo sapiens
MADSAELKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 59681 - protein, 653 aa, Homo sapiens
MFTLQDSYVKQMVMSLRVSELQVLLGYAGRNKHGRKHELLTKALHLLKAGCSPAVQMKIKELYRRRFPQKIMTPADLSIPNVHSSPMPATLSPSTIPQLTYDGHPASSPLLPVSLLGPKHELELPHLTSALHPVHPDIKLQKLPFYDLLDELIKPTSLASDNSQRFRETCFAFALTPQQVQQISSSMDISGTKCDFTVQVQLRFCLSETSCPQEDHFPPNLCVKVNTKPCSLPGYLPPTKNGVEPKRPSRPINITSLVRLSTTVPNTIVVSWTAEIGRNYSMAVYLVKQLSSTVLLQRLRAKGIRNPDHSRALIKEKLTADPDSEIATTSLRVSLLCPLGKMRLTIPCRALTCSHLQCFDATLYIQMNEKKPTWVCPVCDKKAPYEHLIIDGLFMEILKYCTDCDEIQFKEDGTWAPMRSKKEVQEVSASYNGVDGCLSSTLEHQVASHHQSSNKNKKVEVIDLTIDSSSDEEEEEPSAKRTCPSLSPTSPLNNKGILSLPHQASPVSRTPSLPAVDTSYINTSLIQDYRHPFHMTPMPYDLQGLDFFPFLSGDNQHYNTSLLAAAAAAVSDDQDLLHSSRFFPYTSSQMFLDQLSAGGSTSLPTTNGSSSGSNSSLVSSNSLRESHSHTVTNRSSTDTASIFGIIPDIISLD

SEQ ID NO: 59682 - protein, 593 aa, Homo sapiens
MAELGELKHMVMSFRVSELQVLLGFAGRNKSGRKHELLAKALHLLKSSCAPSVQMKIKELYRRRFPRKTLGPSDLSLLSLPPGTSPPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEVCPPPGYGLDGLQYSPVQGGDPSENKKKVEVIDLTIESSSDEEDLPPTKKHCSVTSAAIPALPGSKGVLTSGHQPSSVLRSPAMGTLGGDFLSSLPLHEYPPAFPLGADIQGLDLFSFLQTESQHYGPSVITSLDEQDALGHFFQYRGTPSHFLGPLAPTLGSSHCSATPAPPPGRVSSIVAPGGALREGHGGPLPSGPSLTGCRSDIISLD

SEQ ID NO: 59683 - protein, 290 aa, Homo sapiens [sequence omitted]

SEQ ID NO: 59684 - protein, 628 aa, Homo sapiens
MAELGELKHMVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGRNYSLSVYLVRQLTAGTLLQKLRAKGIRNPDHSRALIKEKLTADPDSEVATTSLRVSLMCPLGKMRLTVPCRALTCAHLQSFDAALYLQMNEKKPTWTCPVCDKKAPYESLIIDGLFMEILSSCSDCDEIQFMEDGSWCPMKPKKEASEVCPPPGYGLDGLQYSPVQGGDPSENKKKVEVIDLTIESSSDEEDLPPTKKHCSVTSAAIPALPGSKGVLTSGHQPSSVLRSPAMGTLGGDFLSSLPLHEYPPAFPLGADIQGLDLFSFLQTESQHYGPSVITSLDEQDALGHFFQYRGTPSHFLGPLAPTLGSSHCSATPAPPPGRVSSIVAPGGALREGHGGPLPSGPSLTGCRSDIISLD

SEQ ID NO: 59685 - protein, 259 aa, Homo sapiens
MVMSFRVSELQVLLGFAGRNKSGRKHELLAKALHLLKSSCAPSVQMKIKELYRRRFPRKTLGPSDLSLLSLPPGTSPVGSPGPLAPIPPTLLAPGTLLGPKREVDMHPPLPQPVHPDVTMKPLPFYEVYGELIRPTTLASTSSQRFEEAHFTFALTPQQVQQILTSREVLPGAKCDYTIQVQLRFCLCETSCPQEDYFPPNLFVKVNGKLCPLPGYLPPTKNGAEPKRPSRPINITPLARLSATVPNTIVVNWSSEFGR

SEQ ID NO: 59686 - protein, 415 aa, Homo sapiens
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIKPMLTDLNTYLNKAIPDTRLTIKKYLDVKFEYLSYCLKVKEMDDEEYSCIALGEPLYRVSTGNYEYRLILRCRQEARARFSQMRKDVLEKMELLDQKHVQDIVFQLQRLVSTMSKYYNDCYAVLRDADVFPIEVDLAHTTLAYGLNQEEFTDGEEEEEEEDTAAGEPSRDTRGAAGPLDKGGSWCDS

SEQ ID NO: 59687 - protein, 415 aa, Homo sapiens; identical to SEQ ID NO: 59686

SEQ ID NO: 59688 - protein, 229 aa, Homo sapiens
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTADALGLSRAILCNDGLVKRLEELERTAELYKGMTEHTKNLLRAFYELSQTHRAFGDVFSVIGVREPQPAASEAFVKFADAHRSIEKFGIRLLKTIK

SEQ ID NO: 59689 - protein, 134 aa, Homo sapiens
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIVLKKVKHRLVENMSSGTA

SEQ ID NO: 59690 - protein, 130 aa, Homo sapiens
MFADLDYDIEEDKLGIPTVPGKVTLQKDAQNLIGISIGGGAQYCPCLYIVQVFDNTPAALDGTVAAGDEITGVNGRSIKGKTKVEVAKMIQEVKGEVTIHYNKLQADPKQGMSLDIGQRLGFHGPGPHSS

SEQ ID NO: 59691 - protein, 38 aa, Homo sapiens
MFADLDYDIEEDKLGIPTVPGKVTLQKDAQNLIGISIG

SEQ ID NO: 59692 - protein, 76 aa, Homo sapiens
MTDVETTYADFIASGRTGRRNAIHDILVSSASGNSNELALKLAGLDINKTEGEEDAQRSSTEQSGEAQGEAAKSES

SEQ ID NO: 59693 - protein, 76 aa, Homo sapiens; identical to SEQ ID NO: 59692

SEQ ID NO: 59694 - protein, 76 aa, Homo sapiens; identical to SEQ ID NO: 59692

SEQ ID NO: 59695 - protein, 85 aa, Homo sapiens
MSHQDVAMRTDSSKMTDVESGVANFASSARAGRRNALPDIQSSAATDGTSDLPLKLEALSVKEDAKEKDEKTTQDQLEKPQNEEK

SEQ ID NO: 59696 - protein, 78 aa, Homo sapiens
MRTDSSKMTDVESGVANFASSARAGRRNALPDIQSSAATDGTSDLPLKLEALSVKEDAKEKDEKTTQDQLEKPQNEEK

SEQ ID NO: 59697 - protein, 87 aa, Homo sapiens
MHILFVDVAMRTDSSKMTDVESGVANFASSARAGRRNALPDIQSSAATDGTSDLPLKLEALSVKEDAKEKDEKTTQDQLEKPQNEEK

SEQ ID NO: 59698 - protein, 78 aa, Homo sapiens; identical to SEQ ID NO: 59696

SEQ ID NO: 59699 - protein, 78 aa, Homo sapiens; identical to SEQ ID NO: 59696

SEQ ID NO: 59700 - protein, 78 aa, Homo sapiens; identical to SEQ ID NO: 59696

SEQ ID NO: 59701 - protein, 78 aa, Homo sapiens; identical to SEQ ID NO: 59696

SEQ ID NO: 59702 - protein, 76 aa, Homo sapiens
MMEVESSYSDFISCDRTGRRNAVPDIQGDSEAVSVRKLAGDMGELALEGAEGQVEGSAPDKEAGNQPQSSDGTTSS

SEQ ID NO: 59703 - protein, 64 aa, Homo sapiens
MMEVESSYSDFISCDRTGRRNAVPDIQGDSEAVSVRKLAGDMGELALEGAEMDLTMLPWLVSNS

SEQ ID NO: 59704 - protein, 76 aa, Homo sapiens; identical to SEQ ID NO: 59702

SEQ ID NO: 59705 - protein, 76 aa, Homo sapiens; identical to SEQ ID NO: 59702

SEQ ID NO: 59706 - protein, 76 aa, Homo sapiens; identical to SEQ ID NO: 59702

SEQ ID NO: 59707 - protein, 76 aa, Homo sapiens; identical to SEQ ID NO: 59702

SEQ ID NO: 59708 - protein, 76 aa, Homo sapiens; identical to SEQ ID NO: 59702

SEQ ID NO: 59709 - protein, 525 aa, Homo sapiens
MPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 59710 - protein, 328 aa, Homo sapiens
MLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 59711 - protein, 444 aa, Homo sapiens
MSSSYDEASLAPEETTDSFWEVGNYKRTVKRIDDGHRLCNDLMNCVQERAKIEKAYGQQLTDWAKRWRQLIEKGPQYGSLERAWGAIMTEADKVSELHQEVKNNLLNEDLEKVKNWQKDAYHKQIMGGFKETKEAEDGFRKAQKPWAKKMKELEAAKKAYHLACKEEKLAMTREMNSKTEQSVTPEQQKKLQDKVDKCKQDVQKTQEKYEKVLEDVGKTTPQYMENMEQVFEQCQQFEEKRLVFLKEVLLDIKRHLNLAENSSYIHVYRELEQAIRGADAQEDLRWFRSTSGPGMPMNWPQFEEWNPDLPHTTTKKEKQPKKAEGVALTNATGAVESTSQAGDRGSVSSYDRGQPYATEWSDDESGNPFGGSETNGGANPFEDDSKGVRVRALYDYDGQEQDELSFKAGDELTKLGEEDEQGWCRGRLDSGQLGLYPANYVEAI

SEQ ID NO: 59712 - protein, 426 aa, Homo sapiens
MSSSYDEASLAPEETTDSFWEVGNYKRTVKRIDDGHRLCNDLMNCVQERAKIEKAYGQQLTDWAKRWRQLIEKGPQYGSLERAWGAIMTEADKVSELHQEVKNNLLNEDLEKVKNWQKDAYHKQIMGGFKETKEAEDGFRKAQKPWAKKMKELEAAKKAYHLACKEEKLAMTREMNSKTEQSVTPEQQKKLQDKVDKCKQDVQKTQEKYEKVLEDVGKTTPQYMENMEQVFEQCQQFEEKRLVFLKEVLLDIKRHLNLAENSSYIHVYRELEQAIRGADAQEDLRWFRSTSGPGMPMNWPQFEEWNPDLPHTTTKKEKQPKKAEGVALTNATGAVESTSQAGDRGSVSSYDRGQPYATEWSDDESGNPFGGSETNGGANPFEDDSKGVRVRALYDYDGQEQDELSFKAGDELTKLGLYPANYVEAI

SEQ ID NO: 59713 - protein, 444 aa, Homo sapiens; identical to SEQ ID NO: 59711

SEQ ID NO: 59714 - protein, 424 aa, Homo sapiens [sequence omitted]

SEQ ID NO: 59715 - protein, 292 aa, Homo sapiens
MAPEEDAGGEALGGSFWEAGNYRRTVQRVEDGHRLCGDLVSCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKPWLKRLKEVEASKKSYHAARKDEKTAQTRETQRQTAPSPRSSCANCRNGWNAVPRRPRRQKLSMSRRWQSCIATLHATWRTWNRPLRPARPPSASGFFSSRICCSPYTSTWTFPAVRSSMNSTVTCTRALRQPVTKRICAGGAAPTGQAWP

SEQ ID NO: 59716 - protein, 69 aa, Homo sapiens
MAPEEDAGGEALGGSFWEAGNYRRTVQRVEDGHRLCGDLVSCFQERARIEKAYAQQLADWARKWRGTVE

SEQ ID NO: 59717 - protein, 142 aa, Homo sapiens
MAPEEDAGGEALGGSFWEAGNYRRTVQRVEDGHRLCGDLVSCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKP

SEQ ID NO: 59718 - protein, 405 aa, Homo sapiens
MAPEEDAGGEALGGSFWEAGNYRRTVQRVEDGHRLCGDLVSCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKPWLKRLKEVEASKKSYHAARKDEKTAQTRESHAKADSAVSQEQLRKLQERVERCAKEAEKTKAQYEQTLAELHRYTPRYMEDMEQAFETCQAAERQRLLFFKDMLLTLHQHLDLSSSEKFHELHRDLHQGIEAASDEEDLRWWRSTHGPGMAMNWPQFEEWSLDTQRTISRKEKGGRSPDEVTLTSIVPTRDGTAPPPQSPGSPGTGQDEEWSDEESPRKAATGVRVRALYDYAGQEADELSFRAGEELLKMSEEDEQGWCQGQ

SEQ ID NO: 59719 - protein, 69 aa, Homo sapiens; identical to SEQ ID NO: 59716

SEQ ID NO: 59720 - protein, 148 aa, Homo sapiens
MAPEEDAGGEALGGSFWEAGNYRRTVQRVEDGHRLCGDLVSCFQERARIEKAYAQQLADWARKWRGTVEKGPQYGTLEKAWHAFFTAAERLSALHLEVREKLQGQDSERVRAWQRGAFHRPVLGGFRESRAAEDGFRKAQKPWLKRLK

SEQ ID NO: 59721 - protein, 424 aa, Homo sapiens [sequence omitted]

SEQ ID NO: 59722 - protein, 528 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEEAPPPLSPPQPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 59723 - protein, 525 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQALLSGDTQTDATSFYDRVWAAIRDKYRSEALPTDLPAPSAPDLTEPKEEQPPVPSSPTEEEEEEEEEEEEEAEEEEEEEDSEVQGEQPKPASPAEEDKMPPYDEQTQAFIDAAQEARNKFEEAERSLKDMEESIRNLEQEISFDFGPNGEFAYLYSQCYELTTNEYVYRLCPFKLVSQKPKLGGSPTSLGTWGSWIGPDHDKFSAMKYEQGTGCWQGPNRSTTVRLLCGKETMVTSTTEPSRCEYLMELMTPAACPEPPPEAPTEDDHDEL

SEQ ID NO: 59724 - protein, 676 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLVKQGLKCEDCGMNVHHKCREKVANLCGINQKLLAEALNQVTQRASRRSDSASSEPVGIYQGFEKKTGVAGEDMQDNSGTYGKIWEGSSKCNINNFIFHKVLGKGSFGKVLLGELKGRGEYFAIKALKKDVVLIDDDVECTMVEKRVLTLAAENPFLTHLICTFQTKDHLFFVMEFLNGGDLMYHIQDKGRFELYRATFYAAEIMCGLQFLHSKGIIYRDLKLDNVLLDRDGHIKIADFGMCKENIFGESRASTFCGTPDYIAPEILQGLKYTFSVDWWSFGVLLYEMLIGQSPFHGDDEDELFESIRVDTPHYPRWITKESKDILEKLFEREPTKRLGVTGNIKIHPFFKTINWTLLEKRRLEPPFRPKVKSPRDYSNFDQEFLNEKARLSYSDKNLIDSMDQSAFAGFSFVNPKFEHLLED

SEQ ID NO: 59725 - protein, 676 aa, Homo sapiens; identical to SEQ ID NO: 59724

SEQ ID NO: 59726 - protein, 77 aa, Homo sapiens
MAPFLRIAFNSYELGSLQAEDEANQPFCAVKMKEALSTERGKTLVQKKPTMYPEWKSTFDAHIYEGRVIQIVLMRAA

SEQ ID NO: 59727 - protein, 125 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDV

SEQ ID NO: 59728 - protein, 683 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLRTTGASDTFEGWVDLEPEGKVFVVITLTGSFTEATLQRDRIFKHFTRKRQRAMRRRVHQINGHKFMATYLRQPTYCSHCREFIWGVFGKQGYQCQVCTCVVHKRCHHLIVTACTCQNNINKVDSKIAEQRFGINIPHKFSIHNYKVPTFCDHCGSLLWGIMRQGLQCKICKMNVHIRCQANVAPNCGVNAVELAKTLAGMGLQPGNISPTSKLVSRSTLRRQGKESSKEGNGIGVNSSNRLGIDNFEFIRVLGKGSFGKVMLARVKETGDLYAVKVLKKDVILQDDDVECTMTEKRILSLARNHPFLTQLFCCFQTPDRLFFVMEFVNGGDLMFHIQKSRRFDEARARFYAAEIISALMFLHDKGIIYRDLKLDNVLLDHEGHCKLADFGMCKEGICNGVTTATFCGTPDYIAPEILQEMLYGPAVDWWAMGVLLYEMLCGHAPFEAENEDDLFEAILNDEVVYPTWLHEDATGILKSFMTKNPTMRLGSLTQGGEHAILRHPFFKEIDWAQLNHRQIEPPFRPRIKSREDVSNFDPDFIKEEPVLTPIDEGHLPMINQDEFRNFSYVSPELQP

SEQ ID NO: 59729 - protein, 118 aa, Homo sapiens
MSSGTMKFNGYLRVRIGEAVGLQPTRWSLRHSLFKKGHQLLDPYLTVSVDQVRVGQTSTKQKTNKPTYNEEFCANVTDGGHLELAVFHETPLGYDHFVANCTLQFQELLRTTGASDTF

SEQ ID NO: 59730 - protein, 596 aa, Homo sapiens
MPTQRDSSTMSHTVAGGGSGDHSHQVRVKAYYRGDIMITHFEPSISFEGLCNEVRDMCSFDNEQLFTMKWIDEEGDPCTVSSQLELEEAFRLYELNKDSELLIHVFPCVPERPGMPCPGEDKSIYRRGARRWRKLYCANGHTFQAKRFNRRAHCAICTDRIWGLGRQGYKCINCKLLVHKKCHKLVTIECGRHSLPQEPVMPMDQSSMHSDHAQTVIPYNPSSHESLDQVGEEKEAMNTRESGKASSSLGLQDFDLLRVIGRGSYAKVLLVRLKKTDRIYAMKVVKKELVNDDEDIDWVQTEKHVFEQASNHPFLVGLHSCFQTESRLFFVIEYVNGGDLMFHMQRQRKLPEEHARFYSAEISLALNYLHERGIIYRDLKLDNVLLDSEGHIKLTDYGMCKEGLRPGDTTSTFCGTPNYIAPEILRGEDYGFSVDWWALGVLMFEMMAGRSPFDIVGSSDNPDQNTEDYLFQVILEKQIRIPRSLSVKAASVLKSFLNKDPKERLGCHPQTGFADIQGHPFFRNVDWDMMEQKQVVPPFKPNISGEFGLDNFDSQFTNEPVQLTPDDDDIVRKIDQSEFEGFEYINPLLMSAEECV

SEQ ID NO: 59731 - protein, 706 aa, Homo sapiens
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 59732 - protein, 643 aa, Homo sapiens
MSPFLRIGLSNFDCGSCQSCQGEAVNPYCAVLVKEYVESENGQMYIQKKPTMYPPWDSTFDAHINKGRVMQIIVKGKNVDLISETTVELYSLAERCRKNNGKTEIWLELKPQGRMLMNARYFLEMSDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPELFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 59733 - protein, 479 aa, Homo sapiens
  MOD_RES (1)..(1): Any amino acid
XLSLLPCLLFLPTIIPKKIVIQRDSLPSKKLSYGLIACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 59734 - protein, 581 aa, Homo sapiens
MDTKDMNEFETEGFFALHQRRGAIKQAKVHHVKCHEFTATFFPQPTFCSVCHEFVWGLNKQGYQCRQCNAAIHKKCIDKVIAKCTGSAINSRETMFHKERFKIDMPHRFKVYNYKSPTFCEHCGTLLWGLARQGLKCDACGMNVHHRCQTKVANLCGINQKLMAEALAMIESTQQARCLRDTEQIFREGPVEIGLPCSIKNEARPPCLPTPGKREPQGISWESPLDEVDKMCHLPEPELNKERPSLQIKLKIEDFILHKMLGKGSFGKVFLAEFKKTNQFFAIKALKKDVVLMDDDVECTMVEKRVLSLAWEHPFLTHMFCTFQTKENLFFVMEYLNGGDLMYHIQSCHKFDLSRATFYAAEIILGLQFLHSKGIVYRDLKLDNILLDKDGHIKIADFGMCKENMLGDAKTNTFCGTPDYIAPEILLGQKYNHSVDWWSFGVLLYEMLIGQSPFHGQDEEELFHSIRMDNPFYPRWLEKEAKDLLVKLFVREPEKRLGVRGDIRQHPLFREINWEELERKEIDPPFRPKVKSPFDCSNFDKEFLNEKPRLSFADRALINSMDQNMFRNFSFMNPGMERLIS

SEQ ID NO: 59735 - protein, 343 aa, Homo sapiens
MASNSSDVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 59736 - protein, 381 aa, Homo sapiens
MESGSTAASEEARSLRECELYVQKHNIQALLKDSIVQLCTARPERPMAFLREYFERLEKEEAKQIQNLQKAGTRTDSREDEISPPPPNPVVKGRRRRGAISAEVYTEEDAASYVRKVIPKDYKTMAALAKAIEKNVLFSHLDDNERSDIFDAMFSVSFIAGETVIQQGDEGDNFYVIDQGETDVYVNNEWATSVGEGGSFGELALIYGTPRAATVKAKTNVKLWGIDRDSYRRILMGSTLRKRKMYEEFLSKVSILESLDKWERLTVADALEPVQFEDGQKIVVQGEPGDEFFIILEGSAAVLQRRSENEEFVEVGRLGPSDYFGEIALLMNRPRAATVVARGPLKCVKLDRPRFERVLGPCSDILKRNIQQYNSFVSLSV

SEQ ID NO: 59737 - protein, 912 aa, Homo sapiens
MSAPPVLRPPSPLLPVAAAAAAAAAALVPGSGPGPAPFLAPVAAPVGGISFHLQIGLSREPVLLLQDSSGDYSLAHVREMACSIVDQKFPECGFYGMYDKILLFRHDPTSENILQLVKAASDIQEGDLIEVVLSASATFEDFQIRPHALFVHSYRAPAFCDHCGEMLWGLVRQGLKCEGCGLNYHKRCAFKIPNNCSGVRRRRLSNVSLTGVSTIRTSSAELSTSAPDEPLLQKSPSESFIGREKRSNSQSYIGRPIHLDKILMSKVKVPHTFVIHSYTRPTVCQYCKKLLKGLFRQGLQCKDCRFNCHKRCAPKVPNNCLGEVTINGDLLSPGAESDVVMEEGSDDNDSERNSGLMDDMEEAMVQDAEMAMAECQNDSGEMQDPDPDHEDANRTISPSTSNNIPLMRVVQSVKHTKRKSSTVMKEGWMVHYTSKDTLRKRHYWRLDSKCITLFQNDTGSRYYKEIPLSEILSLEPVKTSALIPNGANPHCFEITTANVVYYVGENVVNPSSPSPNNSVLTSGVGADVARMWEIAIQHALMPVIPKGSSVGTGTNLHRDISVSISVSNCQIQENVDISTVYQIFPDEVLGSGQFGIVYGGKHRKTGRDVAIKIIDKLRFPTKQESQLRNEVAILQNLHHPGVVNLECMFETPERVFVVMEKLHGDMLEMILSSEKGRLPEHITKFLITQILVALRHLHFKNIVHCDLKPENVLLASADPFPQVKLCDFGFARIIGEKSFRRSVVGTPAYLAPEVLRNKGYNRSLDMWSVGVIIYVSLSGTFPFNEDEDIHDQIQNAAFMYPPNPWKEISHEAIDLINNLLQVKMRKRYSVDKTLSHPWLQDYQTWLDLRELECKIGERYITHESDDLRWEKYAGEQGLQYPTHLINPSASHSDTPETEETEMKALGERVSIL

SEQ ID NO: 59738 - protein, 878 aa, Homo sapiens
MATAPSYPAGLPGSPGPGSPPPPGGLELQSPPPLLPQIPAPGSGVSFHIQIGLTREFVLLPAASELAHVKQLACSIVDQKFPECGFYGLYDKILLFKHDPTSANLLQLVRSSGDIQEGDLVEVVLSASATFEDFQIRPHALTVHSYRAPAFCDHCGEMLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDVRWEQFAAEHPLPGSGLPTDRDLGGACPPQDHDMQGLAERISVL

SEQ ID NO: 59739 - protein, 878 aa, Homo sapiens; identical to SEQ ID NO: 59738

SEQ ID NO: 59740 - protein, 721 aa, Homo sapiens
MLFGLVRQGLKCDGCGLNYHKRCAFSIPNNCSGARKRRLSSTSLASGHSVRLGTSESLPCTAEELSRSTTELLPRRPPSSSSSSSASSYTGRPIELDKMLLSKVKVPHTFLIHSYTRPTVCQACKKLLKGLFRQGLQCKDCKFNCHKRCATRVPNDCLGEALINGDVPMEEATDFSEADKSALMDESEDSGVIPGSHSENALHASEEEEGEGGKAQSSLGYIPLMRVVQSVRHTTRKSSTTLREGWVVHYSNKDTLRKRHYWRLDCKCITLFQNNTTNRYYKEIPLSEILTVESAQNFSLVPPGTNPHCFEIVTANATYFVGEMPGGTPGGPSGQGAEAARGWETAIRQALMPVILQDAPSAPGHAPHRQASLSISVSNSQIQENVDIATVYQIFPDEVLGSGQFGVVYGGKHRKTGRDVAVKVIDKLRFPTKQESQLRNEVAILQSLRHPGIVNLECMFETPEKVFVVMEKLHGDMLEMILSSEKGRLPERLTKFLITQILVALRHLHFKNIVHCDLKPENVLLASADPFPQVKLCDFGFARIIGEKSFRRSVVGTPAYLAPEVLLNQGYNRSLDMWSVGVIMYVSLSGTFPFNEDEDINDQIQNAAFMYPASPWSHISAGAIDLINNLLQVKMRKRYSVDKSLSHPWLQEYQTWLDLRELEGKMGERYITHESDDVRWEQFAAEHPLPGSGLPTDRDLGGACPPQDHDMQGLAERISVL

SEQ ID NO: 59741 - protein, 493 aa, Homo sapiens
MRRRRAAVAAGFCASFLLGSVLNVLFAPGSEPPRPGQSPEPSPAPGPGRRGGRGELARQIRARYEEVQRYSRGGPGPGAGRPERRRLMDLAPGGPGLPRPRPPWARPLSDGAPGWPPAPGPGSPGPGPRLGCAALRNVSGAQYMGSGYTKAVYRVRLPGGAAVALKAVDFSGHDLGSCVREFGVRRGCYRLAAHKLLKEMVLLERLRHPNVLQLYGYCYQDSEDIPDTLTTITELGAPVEMIQLLQTSWEDRFRICLSLGRLLHHLAHSPLGSVTLLDFRPRQFVLVDGELKVTDLDDARVEETPCAGSTDCILEFPARNFTLPCSAQGWCEGMNEKRNLYNAYRFFFTYLLPHSAPPSLRPLLDSIVNATGELAWGVDETLAQLEKVLHLYRSGQYLQNSTASSSTEYQCIPDSTIPQEDYRCWPSYHHGSCLLSVFNLAEAVDVCESHAQCRAFVVTNQTTWTGRQLVFFKTGWSQVVPDPNKTTYVKASG

SEQ ID NO: 59742 - protein, 942 aa, Homo sapiens
MASDAVQSEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 59743 - protein, 948 aa, Homo sapiens
MAEANNPSEQELESEPRSWSLLEQLGLAGADLAAPGVQQQLELERERLRREIRKELKLKEGAENLRRATTDLGRSLGPVELLLRGSSRRLDLLHQQLQELHAHVVLPDPAATHDGPQSPGAGGPTCSATNLSRVAGLEKQLAIELKVKQGAENMIQTYSNGSTKDRKLLLTAQQMLQDSKTKIDIIRMQLRRALQAGQLENQAAPDDTQGSPDLGAVELRIEELRHHFRVEHAVAEGAKNVLRLLSAAKAPDRKAVSEAQEKLTESNQKLGLLREALERRLGELPADHPKGRLLREELAAASSAAFSTRLAGPFPATHYSTLCKPAPLTGTLEVRVVGCRDLPETIPWNPTPSMGGPGTPDSRPPFLSRPARGLYSRSGSLSGRSSLKAEAENTSEVSTVLKLDNTVVGQTSWKPCGPNAWDQSFTLELERARELELAVFWRDQRGLCALKFLKLEDFLDNERHEVQLDMEPQGCLVAEVTFRNPVIERIPRLRRQKKIFSKQQGKAFQRARQMNIDVATWVRLLRRLIPNATGTGTFSPGASPGSEARTTGDISVEKLNLGTDSDSSPQKSSRDPPSSPSSLSSPIQESTAPELPSETQETPGPALCSPLRKSPLTLEDFKFLAVLGRGHFGKVLLSEFRPSGELFAIKALKKGDIVARDEVESLMCEKRILAAVTSAGHPFLVNLFGCFQTPEHVCFVMEYSAGGDLMLHIHSDVFSEPRAIFYSACVVLGLQFLHEHKIVYRDLKLDNLLLDTEGYVKIADFGLCKEGMGYGDRTSTFCGTPEFLAPEVLTDTSYTRAVDWWGLGVLLYEMLVGESPFPGDDEEEVFDSIVNDEVRYPRFLSAEAIGIMRRLLRRNPERRLGSSERDAEDVKKQPFFRTLGWEALLARRLPPPFVPTLSGRTDVSNFDEEFTGEAPTLSPPRDARPLTAAEQAAFLDFDFVAGGC

SEQ ID NO: 59744 - protein, 604 aa, Homo sapiens
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPARYVSEILSISYTKLLGHSYVLIIAGVLSLAFFPSSILKVVFCLLKK

SEQ ID NO: 59745 - protein, 827 aa, Homo sapiens
MIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 59746 - protein, 936 aa, Homo sapiens
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 59747 - protein, 984 aa, Homo sapiens
MASNPERGEILLTELQGDSRSLPFSENVSAVQKLDFSDTMVQQKLDDIKDRIKREIRKELKIKEGAENLRKVTTDKKSLAYVDNILKKSNKKLEELHHKLQELNAHIVVSDPEDITDCPRTPDTPNNDPRCSTSNNRLKALQKQLDIELKVKQGAENMIQMYSNGSSKDRKLHGTAQQLLQDSKTKIEVIRMQILQAVQTNELAFDNAKPVISPLELRMEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTGTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 59748 - protein, 211 aa, Homo sapiens
  MOD_RES (1)..(1): Any amino acid
XEELRHHFRIEFAVAEGAKNVMKLLGSGKVTDRKALSEAQARFNESSQKLDLLKYSLEQRLNEVPKNHPKSRIIIEELSLVAASPTLSPRQSMISTQNQYSTLSKPAALTDDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQR

SEQ ID NO: 59749 - protein, 65 aa, Homo sapiens
  MOD_RES (1)..(1): Any amino acid
XGFVKIADFGLCKEGMGYGDRTSTFCGTPEFLAPEVLTETSYTRAVDWWGLGVLIYEMLVGETSV

SEQ ID NO: 59750 - protein, 658 aa, Homo sapiens
MNSTLEVRLMGCQDILENVPGRSKATSVALPGWSPSETRSSFMSRTSKSKSGSSRNLLKTDDLSNDVCAVLKLDNTVVGQTSWKPISNQSWDQKFTLELDRSRELEISVYWRDWRSLCAVKFLRLEDFLDNQRHGMCLYLEPQGTLFAEVTFFNPVIERRPKLQRQKKIFSKQQGKTFLRAPQMNINIATWGRLVRRAIPTVNHSGTFSPQAPVPTTVPVVDVRIPQLAPPASDSTVTKLDFDLEPEPPPAPPRASSLGEIDESSELRVLDIPGQDSETVFDIQNDRNSILPKSQSEYKPDTPQSGLEYSGIQELEDRRSQQRFQFNLQDFRCCAVLGRGHFGKVLLAEYKNTNEMFAIKALKKGDIVARDEVDSLMCEKRIFETVNSVRHPFLVNLFACFQTKEHVCFVMEYAAGGDLMMHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGESPFPGDDEEEVFDSIVNDEVRYPRFLSTEAISIMRRLLRRNPERRLGASEKDAEDVKKHPFFRLIDWSALMDKKVKPPFIPTIRGREDVSNFDDEFTSEAPILTPPREPRILSEEEQEMFRDFDYIADWC

SEQ ID NO: 59751 - protein, 111 aa, Homo sapiens
MHIHTDVFSEPRAVFYAACVVLGLQYLHEHKIVYRDLKLDNLLLDTEGFVKIADFGLCKEGMGYGDRTSTFCGTPEFLAPEVLTETSYTRAVDWWGLGVLIYEMLVGETSV

SEQ ID NO: 59752 - protein, 889 aa, Homo sapiens
MEEGAPRQPGPSQWPPEDEKEVIRRAIQKELKIKEGVENLRRVATDRRHLGHVQQLLRSSNRRLEQLHGELRELHARILLPGPGPGPAEPVASGPRPWAEQLRARHLEALRRQLHVELKVKQGAENMTHTCASGTPKERKLLAAAQQMLRDSQLKVALLRMKISSLEASGSPEPGPELLAEELQHRLHVEAAVAEGAKNVVKLLSSRRTQDRKALAEAQAQLQESSQKLDLLRLALEQLLEQLPPAHPLRSRVTRELRAAVPGYPQPSGTPVKPTALTGTLQVRLLGCEQLLTAVPGRSPAAALASSPSEGWLRTKAKHQRGRGELASEVLAVLKVDNRVVGQTGWGQVAEQSWDQTFVIPLERARELEIGVHWRDWRQLCGVAFLRLEDFLDNACHQLSLSLVPQGLLFAQVTFCDPVIERRPRLQRQERIFSKRRGQDFLRASQMNLGMAAWGRLVMNLLPPCSSPSTISPPKGCPRTPTTLREASDPATPSNFLPKKTPLGEEMTPPPKPPRLYLPQEPTSEETPRTKRPHMEPRTRRGPSPPASPTRKPPRLQDFRCLAVLGRGHFGKVLLVQFKGTGKYYAIKALKKQEVLSRDEIESLYCEKRILEAVGCTGHPFLLSLLACFQTSSHACFVTEFVPGGDLMMQIHEDVFPEPQARFYVACVVLGLQFLHEKKIIYRDLKLDNLLLDAQGFLKIADFGLCKEGIGFGDRTSTFCGTPEFLAPEVLTQEAYTRAVDWWGLGVLLYEMLVGECPFPGDTEEEVFDCIVNMDAPYPGFLSVQGLEFIQKLLQKCPEKRLGAGEQDAEEIKVQPFFRTTNWQALLARTIQPPFVPTLCGPADLRYFEGEFTGLPPALTPPAPHSLLTARQQAAFRDFDFVSERFLEP

SEQ ID NO: 59753 - protein, 574 aa, Homo sapiens
MRRLSSWRKMATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRKSDVPGVVKTGSTKELDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 59754 - protein, 559 aa, Homo sapiens
MRRLSSWRKMATAEKQKHDGRVKIGHYILGDTLGVGTFGKVKVGKHELTGHKVAVKILNRQKIRSLDVVGKIRREIQNLKLFRHPHIIKLYQVISTPSDIFMVMEYVSGGELFDYICKNGRLDEKESRRLFQQILSGVDYCHRHMVVHRDLKPENVLLDAHMNAKIADFGLSNMMSDGEFLRTSCGSPNYAAPEVISGRLYAGPEVDIWSSGVILYALLCGTLPFDDDHVPTLFKKICDGIFYTPQYLNPSVISLLKHMLQVDPMKRATIKDIREHEWFKQDLPKYLFPEDPSYSSTMIDDEALKEVCEKFECSEEEVLSCLYNRNHQDPLAVAYHLIIDNRRIMNEAKDFYLATSPPDSFLDDHHLTRPHPERVPFLVAETPRARHTLDELNPQKSKHQGVRKAKWHLGIRSQSRPNDIMAEVCRAIKQLDYEWKVVNPYYLRVRRKNPVTSTYSKMSLQLYQVDSRTYLLDFRSIDDEITEAKSGTATPQRSGSVSNYRSCQRSDSDAEAQGKSSEVSLTSSVTSLDSSPVDLTPRPGSHTIEFFEMCANLIKILAQ

SEQ ID NO: 59755 - protein, 552 aa, Homo sapiens
MAEKQKHDGRVKIGHYVLGDTLGVGTFGKVKIGEHQLTGHKVAVKILNRQKIRSLDVVGKIKREIQNLKLFRHPHIIKLYQVISTPTDFFMVMEYVSGGELFDYICKHGRVEEMEARRLFQQILSAVDYCHRHMVVHRDLKPENVLLDAHMNAKIADFGLSNMMSDGEFLRTSCGSPNYAAPEVISGRLYAGPEVDIWSCGVILYALLCGTLPFDDEHVPTLFKKIRGGVFYIPEYLNRSVATLLMHMLQVDPLKRATIKDIREHEWFKQDLPSYLFPEDPSYDANVIDDEAVKEVCEKFECTESEVMNSLYSGDPQDQLAVAYHLIIDNRRIMNQASEFYLASSPPSGSFMDDSAMHIPPGLKPHPERMPPLIADSPKARCPLDALNTTKPKSLAVKKAKWHLGIRSQSKPYDIMAEVYRAMKQLDFEWKVVNAYHLRVRRKNPVTGNYVKMSLQLYLVDNRSYLLDFKSIDDEVVEQRSGSSTPQRSCSAAGLHRPRSSFDSTTAESHSLSGSLTGSLTGSTLSSVSPRLGSHTMDFFEMCASLITTLAR

SEQ ID NO: 59756 - protein, 247 aa, Homo sapiens
MLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 59757 - protein, 331 aa, Homo sapiens
METVISSDSSPAVENEHPQETPESNNSVYTSFMKSHRCYDLIPTSSKLVVFDTSLQVKKAFFALVTNGVRAAPLWDSKKQSFVGMLTITDFINILHRYYKSALVQIYELEEHKIETWREVYLQDSFKPLVCISPNASLFDAVSSLIRNKIHRLPVIDPESGNTLYILTHKRILKFLKLFITEFPKPEFMSKSLEELQIGTYANIAMVRTTTPVYVALGIFVQHRVSALPVVDEKGRVVDIYSKFDVINLAAEKTYNNLDVSVTKALQHRSHYFEGVLKCYLHETLETIINRLVEAEVHRLVVVDENDVVKGIVSLSDILQALVLTGGEKKP

SEQ ID NO: 59758 - protein, 569 aa, Homo sapiens
MGSAVMDTKKKKDVSSPGGSGGKKNASQKRRSLRVHIPDLSSFAMPLLDGDLEGSGKHSSRKVDSPFGPGSPSKGFFSRGPQPRPSSPMSAPVRPKTSPGSPKTVFPFSYQESPPRSPRRMSFSGIFRSSSKESSPNSNPATSPGGIRFFSRSRKTSGLSSSPSTPTQVTKQHTFPLESYKHEPERLENRIYASSSPPDTGQRFCPSSFQSPTRPPLASPTHYAPSKAAALAAALGPAEAGMLEKLEFEDEAVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 59759 - protein, 444 aa, Homo sapiens
MKRFGSLRSNKKHKDQNRSTERRQSEPHGLFASGLSSSPSTPTQVTKQHTFPLESYKHEPERLENRIYASSSPPDTGQRFCPSSFQSPTRPPLASPTHYAPSKAAALAAALGPAEAGMLEKLEFEDEVEDSESGVYMRFMRSHKCYDIVPTSSKLVVFDTTLQVKKAFFALVANGVRAAPLWESKKQSFVGMLTITDFINILHRYYKSPMVQIYELEEHKIETWRELYLQETFKPLVNISPDASLFDAVYSLIKNKIHRLPVIDPISGNALYILTHKRILKFLQLFMSDMPKPAFMKQNLDELGIGTYHNIAFIHPDTPIIKALNIFVERRISALPVVDESGKVVDIYSKFDVINLAAEKTYNNLDITVTQALQHRSQYFEGVVKCNKLEILETIVDRIVRAEVHRLVVVNEADSIVGIISLSDILQALILTPAGAKQKETETE

SEQ ID NO: 59760 - protein, 489 aa, Homo sapiens
MEPGLEHALRRTPSWSSLGGSEHQEMSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLVQIYEIEQHKIETWREIYLQGCFKPLVSISPNDSLFEAVYTLIKNRIHRLPVLDPVSGNVLHILTHKRLLKFLHIFGSLLPRPSFLYRTIQDLGIGTFRDLAVVLETAPILTALDIFVDRRVSALPVVNECGQVVGLYSRFDVIHLAAQQTYNHLDMSVGEALRQRTLCLEGVLSCQPHESLGEVIDRIAREQVHRLVLVDETQHLLGVVSLSDILQALVLSPAGIDALGA

SEQ ID NO: 59761 - protein, 353 aa, Homo sapiens
MEPGLEHALRRTPSWSSLGGSEHQEMSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLRSTCKAASSLWSPSLLMIACLKLSTPSSRTGSIACLFLTRCQATYSTSSHTNACSSSCTSLVPCCPGPPSSTALSKIWASAHSETWLWCWRQHPS

SEQ ID NO: 59762 - protein, 464 aa, Homo sapiens
MSFLEQENSSSWPSPAVTSSSERIRGKRRAKALRWTRQKSVEEGEPPGQGEGPRSRPAAESTGLEATFPKTTPLAQADPAGVGTPPTGWDCLPSDCTASAAGSSTDDVELATEFPATEAWECELEGLLEERPALCLSPQAPFPKLGWDDELRKPGAQIYMRFMQEHTCYDAMATSSKLVIFDTMLEIKKAFFALVANGVRAAPLWDSKKQSFVGMLTITDFILVLHRYYRSPLVQIYEIEQHKIETWREIYLQGCFKPLVSISPNDSLFEAVYTLIKNRIHRLPVLDPVSGNVLHILTHKRLLKFLHIFGSLLPRPSFLYRTIQDLGIGTFRDLAVVLETAPILTALDIFVDRRVSALPVVNECGQVVGLYSRFDVIHLAAQQTYNHLDMSVGEALRQRTLCLEGVLSCQPHESLGEVIDRIAREQVHRLVLVDETQHLLGVVSLSDILQALVLSPAGIDALGA

SEQ ID NO: 59763 - protein, 489 aa, Homo sapiens; identical to SEQ ID NO: 59760

SEQ ID NO: 59764 - protein, 305 aa, Homo sapiens
MRFMQEHTCYDAMATSSKLVIFDTMLEIKKAFFALVANGVRAAPLWDSKKQSFVGMLTITDFILVLHRYYRSPLVQIYEIEQHKIETWREIYLQGCFKPLVSISPNDSLFEAVYTLIKNRIHRLPVLDPVSGNVLHILTHKRLLKFLHIFGSLLPRPSFLYRTIQDLGIGTFRDLAVVLETAPILTALDIFVDRRVSALPVVNECGQVVGLYSRFDVIHLAAQQTYNHLDMSVGEALRQRTLCLEGVLSCQPHESLGEVIDRIAREQVHRLVLVDETQHLLGVVSLSDILQALVLSPAGIDALGA

SEQ ID NO: 59765 - protein, 351 aa, Homo sapiens
MGNAAAAKKGSEQESVKEFLAKAKEDFLKKWESPAQNTAHLDQFERIKTLGTGSFGRVMLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVNDIKNHKWFATTDWIAIYQRKVEAPFIPKFKGPGDTSNFDDYEEEEIRVSINEKCGKEFSEF

SEQ ID NO: 59766 - protein, 343 aa, Homo sapiens; identical to SEQ ID NO: 59735

SEQ ID NO: 59767 - protein, 351 aa, Homo sapiens; identical to SEQ ID NO: 59765

SEQ ID NO: 59768 - protein, 230 aa, Homo sapiens
MLVKHKETGNHYAMKILDKQKVVKLKQIEHTLNEKRILQAVNFPFLVKLEFSFKDNSNLYMVMEYVPGGEMFSHLRRIGRFSEPHARFYAAQIVLTFEYLHSLDLIYRDLKPENLLIDQQGYIQVTDFGFAKRVKGRTWTLCGTPEYLAPEIILSKGYNKAVDWWALGVLIYEMAAGYPPFFADQPIQIYEKIVSGKVRSGCGDTALEETDRSLLTHPIPWGALLVVRII

SEQ ID NO: 59769 - protein, 357 aa, Homo sapiens
MGLSRKSSDASACSSSEISDFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 59770 - protein, 264 aa, Homo sapiens
MSARKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKQNF

SEQ ID NO: 59771 - protein, 313 aa, Homo sapiens
MPDLKILKGKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 59772 - protein, 355 aa, Homo sapiens
MGLSRKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 59773 - protein, 245 aa, Homo sapiens
MGLLKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKNF

SEQ ID NO: 59774 - protein, 398 aa, Homo sapiens
MAAYREPPCNQYTGTTTALQKLEGFASRLFHRHSKGTAHDQKTALENDSLHFSEHTALWDRSMKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 59775 - protein, 257 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKNF

SEQ ID NO: 59776 - protein, 351 aa, Homo sapiens
MGNAATAKKGSEVESVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 59777 - protein, 358 aa, Homo sapiens
MGLSRKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 59778 - protein, 321 aa, Homo sapiens
MSARKSSDASACSSSEISVKEFLAKAKEDFLKKWENPTQNNAGLEDFERKKTLGTGSFGRVMLVKHKATEQYYAMKILDKQKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNKAVDWWALGVLIYEMAAGYPPFFADQPIQIYEKIVSGKVRFPSHFSSDLKDLLRNLLQVDLTKRFGNLKNGVSDIKTHKWFATTDWIAIYQRKVEAPFIPKFRGSGDTSNFDDYEEEDIRVSITEKCAKEFGEF

SEQ ID NO: 59779 - protein, 209 aa, Homo sapiens
MSACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSK

SEQ ID NO: 59780 - protein, 197 aa, Homo sapiens
MSVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEI

SEQ ID NO: 59781 - protein, 214 aa, Homo sapiens
MGLSCSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTPEYLAPEIILSKGYNK

SEQ ID NO: 59782 - protein, 186 aa, Homo sapiens
MGLSRKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQ

SEQ ID NO: 59783 - protein, 175 aa, Homo sapiens
MGLSRKSSDASACSSSEISDSFVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDL

SEQ ID NO: 59784 - protein, 206 aa, Homo sapiens
MSARKSSDASACSSSEISVKEFLAKAKEDFLKKWENPTQNNAGLEDFERKKTLGTGSFGRVMLVKHKATEQYYAMKILDKQKVVKLKQIEHTLNEKRILQAVNFPFLVRLEYAFKDNSNLYMVMEYVPGGEMFSHLRRIGRFSEPHARFYAAQIVLTFEYLHSLDLIYRDLKPENLLIDHQGYIQVTDFGFAKRVKGRTWTLCGTP

SEQ ID NO: 59785 - protein, 351 aa, Homo sapiens
MGNAPAKKDTEQEESVNEFLAKARGDFLYRWGNPAQNTASSDQFERLRTLGMGSFGRVMLVRHQETGGHYAMKILNKQKVVKMKQVEHILNEKRILQAIDFPFLVKLQFSFKDNSYLYLVMEYVPGGEMFSRLQRVGRFSEPHACFYAAQVVLAVQYLHSLDLIHRDLKPENLLIDQQGYLQVTDFGFAKRVKGRTWTLCGTPEYLAPEIILSKGYNKAVDWWALGVLIYEMAVGFPPFYADQPIQIYEKIVSGRVRFPSKLSSDLKHLLRSLLQVDLTKRFGNLRNGVGDIKNHKWFATTSWIAIYEKKVEAPFIPKYTGPGDASNFDDYEEEELRISINEKCAKEFSEF

SEQ ID NO: 59786 - protein, 381 aa, Homo sapiens; identical to SEQ ID NO: 59736

SEQ ID NO: 59787 - protein, 381 aa, Homo sapiens; identical to SEQ ID NO: 59736

SEQ ID NO: 59788 - protein, 381 aa, Homo sapiens; identical to SEQ ID NO: 59736

SEQ ID NO: 59789 - protein, 381 aa, Homo sapiens; identical to SEQ ID NO: 59736

SEQ ID NO: 59790 - protein, 80 aa, Homo sapiens
MGSTLRKRKMYEEFLSKVSILESLEKWERLTVADALEPVQFEDGEKIVVQGEPGDDFYIITEKNLPGVVAHACNPSYLGG

SEQ ID NO: 59791 - protein, 381 aa, Homo sapiens
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITEGTASVLQRRSPNEEYVEVGRLGPSDYFGEIALLLNRPRAATVVARGPLKCVKLDRPRFERVLGPCSEILKRNIQRYNSFISLTV

SEQ ID NO: 59792 - protein, 381 aa, Homo sapiens; identical to SEQ ID NO: 59791

SEQ ID NO: 59793 - protein, 381 aa, Homo sapiens; identical to SEQ ID NO: 59791

SEQ ID NO: 59794 - protein, 165 aa, Homo sapiens
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVI

SEQ ID NO: 59795 - protein, 297 aa, Homo sapiens
MASPPACPSEEDESLKGCELYVQLHGIQQVLKDCIVHLCISKPERPMKFLREHFEKLEKEENRQILARQKSNSQSDSHDEEVSPTPPNPVVKARRRRGGVSAEVYTEEDAVSYVRKVIPKDYKTMTALAKAISKNVLFAHLDDNERSDIFDAMFPVTHIAGETVIQQGNEGDNFYVVDQGEVDVYVNGEWVTNISEGGSFGELALIYGTPRAATVKAKTDLKLWGIDRDSYRRILMGSTLRKRKMYEEFLSKVSILESLEKWERLTVADALEPVQFEDGEKIVVQGEPGDDFYIITE

SEQ ID NO: 59796 - protein, 58 aa, Homo sapiens
MASPPACPSEEDESLKGCELYVQLHGIQQVLKDCIVHLCISKPERPMKFLREHFEKLE

SEQ ID NO: 59797 - protein, 381 aa, Homo sapiens; identical to SEQ ID NO: 59791

SEQ ID NO: 59798 - protein, 381 aa, Homo sapiens; identical to SEQ ID NO: 59791

SEQ ID NO: 59799 - protein, 404 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQGEKADSFYIIESGEVSILIRSRTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 59800 - protein, 382 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 59801 - protein, 404 aa, Homo sapiens; identical to SEQ ID NO: 59799

SEQ ID NO: 59802 - protein, 418 aa, Homo sapiens
MSIEIPAGLTELLQGFTVEVLRHQPADLLEFALQHFTRLQQENERKGTARFGHEGRTWGDLGAAAGGGTPSKGVNFAEEPMQSDSEDGEEEEAAPADAGAFNAPVINRFTRRASVCAEAYNPDEEEDDAESRIIHPKTDDQRNRLQEACKDILLFKNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 59803 - protein, 405 aa, Homo sapiens
MSIEIPAGLTELLQGFTVEVLRHQPADLLEFALQHFTRLQQENERKGTARFGHEGRTWGDLGAAAGGGTPSKGVNFAEEAAPADAGAFNAPVINRFTRRASVCAEAYNPDEEEDDAESRIIHPKTDDQRNRLQEACKDILLFKNLDPEQMSQVLDAMFEKLVKDGEHVIDQGDDGDNFYVIDRGTFDIYVKCDGVGRCVGNYDNRGSFGELALMYNTPRAATITATSPGALWGLDRVTFRRIIVKNNAKKRKMYESFIESLPFLKSLEFSERLKVVDVIGTKVYNDGEQIIAQGDSADSFFIVESGEVKITMKRKGKSEVEENGAVEIARCSRGQYFGELALVTNKPRAASAHAIGTVKCLAMDVQAFERLLGPCMEIMKRNIATYEEQLVALFGTNMDIVEPTA

SEQ ID NO: 59804 - protein, 418 aa, Homo sapiens; identical to SEQ ID NO: 59802

SEQ ID NO: 59805 - protein, 389 aa, Homo sapiens
MEKQNMFLHGSYILREDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 59806 - protein, 283 aa, Homo sapiens
MKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 59807 - protein, 181 aa, Homo sapiens
SCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGWTWNLFEYVVE

SEQ ID NO: 59808 - protein, 686 aa, Homo sapiens
MGTLRDLQYALQEKIEELRQRDALIDELELELDQKDELIQKLQNELDKYRSVIRPATQQAQKQSASTLQGEPRTKRQAISAEPTAFDIQDLSHVTLPFYPKSPQSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 59809 - protein, 659 aa, Homo sapiens
MLKEERIKELEKRLSEKEEEIQELKRKLHKCQSVLPVPSTHIGPRTTRAQGISAEPQTYRSFHDLRQAFRKFTKSERSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 59810 - protein, 671 aa, Homo sapiens
MSELEEDFAKILMLKEERIKELEKRLSEKEEEIQELKRKLHKCQSVLPVPSTHIGPRTTRAQGISAEPQTYRSFHDLRQAFRKFTKSERSKDLIKEAILDNDFMKNLELSQIQEIVDCMYPVEYGKDSCIIKEGDVGSLVYVMEDGKVEVTKEGVKLCTMGPGKVFGELAILYNCTRTATVKTLVNVKLWAIDRQCFQTIMMRTGLIKHTEYMEFLKSVPTFQSLPEEILSKLADVLEETHYENGEYIIRQGARGDTFFIISKGTVNVTREDSPSEDPVFLRTLGKGDWFGEKALQGEDVRTANVIAAEAVTCLVIDRDSFKHLIGGLDDVSNKAYEDAEAKAKYEAEAAFFANLKLSDFNIIDTLGVGGFGRVELVQLKSEESKTFAMKILKKRHIVDTRQQEHIRSEKQIMQGAHSDFIVRLYRTFKDSKYLYMLMEACLGGELWTILRDRGSFEDSTTRFYTACVVEAFAYLHSKGIIYRDLKPENLILDHRGYAKLVDFGFAKKIGFGKKTWTFCGTPEYVAPEIILNKGHDISADYWSLGILMYELLTGSPPFSGPDPMKTYNIILRGIDMIEFPKKIAKNAANLIKKLCRDNPSERLGNLKNGVKDIQKHKWFEGFNWEGLRKGTLTPPIIPSVASPTDTSNFDSFPEDNDEPPPDDNSGWDIDF

SEQ ID NO: 59811 - protein, 762 aa, Homo sapiens
MGNGSVKPKHSKHPDGHSGNLTTDALRNKVTELERELRRKDAEIQEREYHLKELREQLSKQTVAIAELTEELQNKCIQLNKLQDVVHMQGGSPLQASPDKVPLEVHRKTSGLVSLHSRRGAKAGVSAEPTTRTYDLNKPPEFSFEKARVRKDSSEKKLITDALNKNQFLKRLDPQQIKDMVECMYGRNYQQGSYIIKQGEPGNHIFVLAEGRLEVFQGEKLLSSIPMWTTFGELAILYNCTRTASVKAITNVKTWALDREVFQNIMRRTAQARDEQYRNFLRSVSLLKNLPEDKLTKIIDCLEVEYYDKGDYIIREGEEGSTFFILAKGKVKVTQSTEGHDQPQLIKTLQKGEYFGEKALISDDVRSANIIAEENDVACLVIDRETFNQTVGTFEELQKYLEGYVANLNRDDEKRHAKRSMSNWKLSKALSLEMIQLKEKVARFSSSSPFQNLEIIATLGVGGFGRVELVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 59812 - protein, 762 aa, Homo sapiens; identical to SEQ ID NO: 59811

SEQ ID NO: 59813 - protein, 733 aa, Homo sapiens
MGNGSVKPKHSKHPDGHSGNLTTDALRNKVTELERELRRKDAEIQEREYHLKELREQLSKQTVAIAELTEELQNKCIQLNKLQDVVHMQGGSPLQASPDKVPLEVHRKTSGLVSLHSRRGAKAGVSAEPTTRTYDLNKPPEFSFEKARVRKDSSEKKLITDALNKNQFLKRLDPQQIKDMVECMYGRNYQQGSYIIKQGEPGNHIFVLAEGRLEVFQGEKLLSSIPMWTTFGELAILYNCTRTASVKAITNVKTWALDREVFQNIMRRTAQARDEQYRNFLRSVSLLKNLPEDKLTKIIDCLEVEYYDKGDYIIREGEEGSTFFILAKGKVKVTQSTEGHDQPQLIKTLQKGEYFGEKALISDDVRSANIIAEENDVACLVIDRETFNQTVGTFEELQKYLEGYVANLNRDDEKRHAKRSMSNWKLSKALSLEMIQLKEKVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 59814 - protein, 342 aa, Homo sapiens
MSNWKLSKALSLEMIQLKEKVARFSSSSPFQNLEIIATLGVGGFGRVELVKVKNENVAFAMKCIRKKHIVDTKQQEHVYSEKRILEELCSPFIVKLYRTFKDNKYVYMLLEACLGGELWSILRDRGSFDEPTSKFCVACVTEAFDYLHRLGIIYRDLKPENLILDAEGYLKLVDFGFAKKIGSGQKTWTFCGTPEYVAPEVILNKGHDFSVDFWSLGILVYELLTGNPPFSGVDQMMTYNLILKGIEKMDFPRKITRRPEDLIRRLCRQNPTERLGNLKNGINDIKKHRWLNGFNWEGLKARSLPSPLQRELKGPIDHSYFDKYPPEKGMPPDELSGWDKDF

SEQ ID NO: 59815 - protein, 313 aa, Homo sapiens
MSQSRHRAEAPPLEREDSGTFSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 59816 - protein, 302 aa, Homo sapiens
MQSTPFCGFCSLGKMITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 59817 - protein, 200 aa, Homo sapiens
MPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 59818 - protein, 288 aa, Homo sapiens
MITAKPGKTPIQVLHEYGMKTKNIPVYECERSDVQIHVPTFTFRVTVGDITCTGEGTSKKLAKHRAAEAAINILKANASICFAVPDPLMPDPSKQPKNQLNPIGSLQELAIHHGWRLPEYTLSQEGGPAHKREYTTICRLESFMETGKGASKKQAKRNAAEKFLAKFSNISPENHISLTNVVGHSLGCTWHSLRNSPGEKINLLKRSLLSIPNTDYIQLLSEIAKEQGFNITYLDIDELSANGQYQCLAELSTSPITVCHGSGISCGNAQSDAAHNALQYLKIIAERK

SEQ ID NO: 59819 - protein, 358 aa, Homo sapiens
MEAPGLAQAAAAESDSRKVAEETPDGAPALCPSPEALSPEPPVYSLQDFDTLATVGTGTFGRVHLVKEKTAKHFFALKVMSIPDVIRLKQEQHVHNEKSVLKEVSHPFLIRLFWTWHDERFLYMLMEYVPGGELFSYLRNRGRFSSTTGLFYSAEIICAIEYLHSKEIVYRDLKPENILLDRDGHIKLTDFGFAKKLVDRTWTLCGTPEYLAPEVIQSKGHGRAVDWWALGILIFEMLSGFPPFFDDNPFGIYQKILAGKIDFPRHLDFHVKDLIKKLLVVDRTRRLGNMKNGANDVKHHRWFRSVDWEAVPQRKLKPPIVPKIAGDGDTSNFETYPENDWDTAAPVPQKDLEIFKNF

SEQ ID NO: 59820 - protein, 660 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLMVGVPASPYSVKKPPSVTPIFLEPPPKEEGAPGAPEQT

SEQ ID NO: 59821 - protein, 748 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLMSEEATLSHPNFPGATPKGGGSPRSPRTDMRPPPGPCGAGPGSESNLFIDCPEGLENRPNLEGLDFFLGWNAALRVGLALTQETAVPNPWTGPAGAHMLTQTHSETLRHWTRPPLSLLFVQISKAG

SEQ ID NO: 59822 - protein, 748 aa, Homo sapiens; identical to SEQ ID NO: 59821

SEQ ID NO: 59823 - protein, 200 aa, Homo sapiens
MDDWKPSPLIKPFGARKKRSWYLTWKYKLTNQRALRRFCQTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKVLSSGRNILNHLPSLPGGTQSC

SEQ ID NO: 59824 - protein, 638 aa, Homo sapiens
MEGTKEIKVSNRRIQEHWTGAVLFLLVTVIVNIKLILDTRRAISEANEDPEPEQDYDEALGRLEPPRRRGSGPRRVLDVEVYSSRSKVYVAVDGTTVLEDEAREQGRGIHVIVLNQATGHVMAKRVFDTYSPHEDEAMVLFLNMVAPGRVLICTVKDEGSFHLKDTAKALLRSLGSQAGPALGWRDTWAFVGRKGGPVFGEKHSKSPALSSWGDPVLLKTDVPLSSAEEAECHWADTELNRRRRRFCSKVEGYGSVCSCKDPTPIEFSPDPLPDNKVLNVPVAVIAGNRPNYLYRMLRSLLSAQGVSPQMITVFIDGYYEEPMDVVALFGLRGIQHTPISIKNARVSQHYKASLTATFNLFPEAKFAVVLEEDLDIAVDFFSFLSQSIHLLEEDDSLYCISAWNDQGYEHTAEDPALLYRVETMPGLGWVLRRSLYKEELEPKWPTPEKLWDWDMWMRMPEQRRGRECIIPDVSRSYHFGIVGLNMNGYFHEAYFKKHKFNTVPGVQLRNVDSLKKEAYEVEVHRLLSEAEVLDHSKNPCEDSFLPDTEGHTYVAFIRMEKDDDFTTWTQLAKCLHIWDLDVRGNHRGLWRLFRKKNHFLMVGVPASPYSVKKPPSVTPIFLEPPPKEEGAPGAPEQT

SEQ ID NO: 59825 - protein, 286 aa, Homo sapiens
MSDSEKLNLDSIIGRLLEGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 59826 - protein, 515 aa, Homo sapiens
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAEYFINHGASVGIVNSEGEVPSDLAEEPAMKDLLLEQVKKQGVDLEQSRKEEEQQMLQDARQWLNSGKIEDVRQARSGATALHVAAAKGYSEVLRLLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEADKKPEAFVNHSNSESKSSITEQIPAPAQNTFSASSARRFSSGLFNKPEEPKDESPSSWRLGLRKTGSHNMLSEVANSREPIRDRGSSIYRSSSSPRISALLDNKDKVQFGRVWGNSKAVFFFHENSILGTNENIF

SEQ ID NO: 59827 - protein, 1374 aa, Homo sapiens
MLKTESSGERTTLRSASPHRNAYRTEFQALKSTFDKPKSDGEQKTKEGEGSQQSRGRKYGSNVNRIKNLFMQMGMEPNENAAVIAKTRGKGGHSSPQRRMKPKEFLEKTDGSVVKLESSVSERISRFDTMYDGPSYSKFTETRKMFERSVHESGQNNRYSPKKEKAGGSEPQDEWGGSKSNRGSTDSLDSLSSRTEAVSPTVSQLSAVFENTDSPSAIISEKAENNEYSVTGHYPLNLPSVTVTNLDTFGHLKDSNSWPPSNKRGVDTEDAHKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDENTVAELQGMSGNCNNNNNYFLKTGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKPSNSFYNHMHITKLLPPKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKVENTWITKANKRNPNPSSSSIFGRHSQLMSVVWIQETNNFTFNDDFSPSSTSSADLSGLGAEPKTPGLSQSLALSSDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 59828 - protein, 341 aa, Homo sapiens
MSDSEKLNLDSIIGRLLEGSRVLTPHCAPVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 59829 - protein, 330 aa, Homo sapiens
MSDSEKLNLDSIIGRLLEVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGRPITPPRNSAKAKK

SEQ ID NO: 59830 - protein, 414 aa, Homo sapiens
MRQRADRRSMVSTSGAATASSAAGPSRGAAHSPSSAPHASRHRPPFSSRATGLLQQRQHCVHHCTQLCPRVQTPCLPPPPAPATELHSYLQQGGERGLLDTTPGTAGWGTSATGAVQGSRPGKNVQLTENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVQGWGENDRGVSFTFGAEVVAKFLHKHDLDLICRAHQVVEDGYEFFAKRQLVTLFSAPNYCGEFDNAGAMMSVDETLMCSFQILKPADKNKGKYGQFSGLNPGGR

SEQ ID NO: 59831 - protein, 327 aa, Homo sapiens
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDTGLLCDLLWSDPDKDVQGWGENDRGVSFTFGADVVSKFLNRHDLDLICRAHQVVEDGYEFFAKRQLVTLFSAPNYCGEFDNAGGMMSVDETLMCSFQILKPSEKKAKYQYGGLNSGRPVTPPRTANPPKKR

SEQ ID NO: 59832 - protein, 327 aa, Homo sapiens; identical to SEQ ID NO: 59831

SEQ ID NO: 59833 - protein, 327 aa, Homo sapiens; identical to SEQ ID NO: 59831

SEQ ID NO: 59834 - protein, 125 aa, Homo sapiens
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHE

SEQ ID NO: 59835 - protein, 138 aa, Homo sapiens
MADGELNVDSLITRLLEVRGCRPGKIVQMTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDE

SEQ ID NO: 59836 - protein, 169 aa, Homo sapiens
MTEAEVRGLCIKSREIFLSQPILLELEAPLKICGDIHGQYTDLLRLFEYGGFPPEANYLFLGDYVDRGKQSLETICLLLAYKIKYPENFFLLRGNHECASINRIYGFYDECKRRFNIKLWKTFTDCFNCLPIAAIVDEKIFCCHGGLSPDLQSMEQIRRIMRPTDVPDT

SEQ ID NO: 59837 - protein, 323 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 59838 - protein, 337 aa, Homo sapiens
MADLDKLNIDSIIQRLLEVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRVASGLNPSIQKASNYRNNTVLYE

SEQ ID NO: 59839 - protein, 332 aa, Homo sapiens
MFLPLYLNLVLYFVFWLHWTNCDFSLAVRGSKPGKNVQLQENEIRGLCLKSREIFLSQPILLELEAPLKICGDIHGQYYDLLRLFEYGGFPPESNYLFLGDYVDRGKQSLETICLLLAYKIKYPENFFLLRGNHECASINRIYGFYDECKRRYNIKLWKTFTDCFNCLPIAAIVDEKIFCCHGGLSPDLQSMEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 59840 - protein, 141 aa, Homo sapiens
MEQIRRIMRPTDVPDQGLLCDLLWSDPDKDVLGWGENDRGVSFTFGAEVVAKFLHKHDLDLICRAHQVVEDGYEFFAKRQLVTLFSAPNYCGEFDNAGAMMSVDETLMCSFQILKPAEKKKPNATRPVTPPRGMITKQAKK

SEQ ID NO: 59841 - protein, 74 aa, Homo sapiens
MGRRSSKCCCIYEKPRAFGESSTESDEEEEEGCGHTHCVRGHRKGRRRATLGPTPTTPPQPPDPSQPPPGPMQH

SEQ ID NO: 59842 - protein, 74 aa, Homo sapiens; identical to SEQ ID NO: 59841

SEQ ID NO: 59843 - protein, 74 aa, Homo sapiens; identical to SEQ ID NO: 59841

SEQ ID NO: 59844 - protein, 74 aa, Homo sapiens; identical to SEQ ID NO: 59841

SEQ ID NO: 59845 - protein, 126 aa, Homo sapiens
MAEAGAGLSETVTETTVTVTTEPENRSLTIKLRKRKPEKKVEWTSDTVDNEHMGRRSSKCCCIYEKPRAFGESSTESDEEEEEGCGHTHCVRGHRKGRRRATLGPTPTTPPQPPDPSQPPPGPMQH

SEQ ID NO: 59846 - protein, 74 aa, Homo sapiens; identical to SEQ ID NO: 59841

SEQ ID NO: 59847 - protein, 126 aa, Homo sapiens; identical to SEQ ID NO: 59845

SEQ ID NO: 59848 - protein, 74 aa, Homo sapiens; identical to SEQ ID NO: 59841

SEQ ID NO: 59849 - protein, 74 aa, Homo sapiens; identical to SEQ ID NO: 59841

SEQ ID NO: 59850 - protein, 74 aa, Homo sapiens; identical to SEQ ID NO: 59841

SEQ ID NO: 59851 - protein, 74 aa, Homo sapiens; identical to SEQ ID NO: 59841

SEQ ID NO: 59852 - protein, 74 aa, Homo sapiens; identical to SEQ ID NO: 59841

SEQ ID NO: 59853 - protein, 74 aa, Homo sapiens; identical to SEQ ID NO: 59841

SEQ ID NO: 59854 - protein, 74 aa, Homo sapiens; identical to SEQ ID NO: 59841

SEQ ID NO: 59855 - protein, 74 aa, Homo sapiens; identical to SEQ ID NO: 59841

SEQ ID NO: 59856 - protein, 74 aa, Homo sapiens; identical to SEQ ID NO: 59841

SEQ ID NO: 59857 - protein, 74 aa, Homo sapiens; identical to SEQ ID NO: 59841

SEQ ID NO: 59858 - protein, 74 aa, Homo sapiens; identical to SEQ ID NO: 59841

SEQ ID NO: 59859 - protein, 74 aa, Homo sapiens; identical to SEQ ID NO: 59841

SEQ ID NO: 59860 - protein, 74 aa, Homo sapiens; identical to SEQ ID NO: 59841

SEQ ID NO: 59861 - protein, 74 aa, Homo sapiens; identical to SEQ ID NO: 59841

SEQ ID NO: 59862 - protein, 74 aa, Homo sapiens; identical to SEQ ID NO: 59841

SEQ ID NO: 59863 - protein, 126 aa, Homo sapiens; identical to SEQ ID NO: 59845

SEQ ID NO: 59864 - protein, 126 aa, Homo sapiens; identical to SEQ ID NO: 59845

SEQ ID NO: 59865 - protein, 74 aa, Homo sapiens; identical to SEQ ID NO: 59841

SEQ ID NO: 59866 - protein, 74 aa, Homo sapiens; identical to SEQ ID NO: 59841

SEQ ID NO: 59867 - protein, 74 aa, Homo sapiens; identical to SEQ ID NO: 59841

SEQ ID NO: 59868 - protein, 126 aa, Homo sapiens; identical to SEQ ID NO: 59845

SEQ ID NO: 59869 - protein, 74 aa, Homo sapiens; identical to SEQ ID NO: 59841

SEQ ID NO: 59870 - protein, 74 aa, Homo sapiens; identical to SEQ ID NO: 59841

SEQ ID NO: 59871 - protein, 126 aa, Homo sapiens; identical to SEQ ID NO: 59845

SEQ ID NO: 59872 - protein, 74 aa, Homo sapiens; identical to SEQ ID NO: 59841

SEQ ID NO: 59873 - protein, 74 aa, Homo sapiens; identical to SEQ ID NO: 59841

SEQ ID NO: 59874 - protein, 74 aa, Homo sapiens; identical to SEQ ID NO: 59841

SEQ ID NO: 59875 - protein, 74 aa, Homo sapiens; identical to SEQ ID NO: 59841

SEQ ID NO: 59876 - protein, 74 aa, Homo sapiens; identical to SEQ ID NO: 59841

SEQ ID NO: 59877 - protein, 74 aa, Homo sapiens; identical to SEQ ID NO: 59841

SEQ ID NO: 59878 - protein, 126 aa, Homo sapiens; identical to SEQ ID NO: 59845

SEQ ID NO: 59879 - protein, 74 aa, Homo sapiens; identical to SEQ ID NO: 59841

SEQ ID NO: 59880 - protein, 74 aa, Homo sapiens; identical to SEQ ID NO: 59841

SEQ ID NO: 59881 - protein, 74 aa, Homo sapiens; identical to SEQ ID NO: 59841

SEQ ID NO: 59882 - protein, 74 aa, Homo sapiens; identical to SEQ ID NO: 59841

SEQ ID NO: 59883 - protein, 74 aa, Homo sapiens; identical to SEQ ID NO: 59841

SEQ ID NO: 59884 - protein, 74 aa, Homo sapiens; identical to SEQ ID NO: 59841

SEQ ID NO: 59885 - protein, 126 aa, Homo sapiens; identical to SEQ ID NO: 59845

SEQ ID NO: 59886 - protein, 74 aa, Homo sapiens; identical to SEQ ID NO: 59841

SEQ ID NO: 59887 - protein, 74 aa, Homo sapiens; identical to SEQ ID NO: 59841

SEQ ID NO: 59888 - protein, 74 aa, Homo sapiens; identical to SEQ ID NO: 59841

SEQ ID NO: 59889 - protein, 147 aa, Homo sapiens
MADSGTAGGAALAAPAPGPGSGGPGPRVYFQSPPGAAGEGPGGADDEGPVRRQGKVTVKYDRKELRKRLNLEEWILEQLTRLYDCQEEEIPELEIDVDELLDMESDDARAARVKELLVDCYKPTEAFISGLLDKIRGMQKLSTPQKK

SEQ ID NO: 59890 - protein, 165 aa, Homo sapiens
MSVATGSSETAGGASGGGARVFFQSPRGGAGGSPGSSSGSGSSREDSAPVATAAAAGQVQQQQQRRHQQGKVTVKYDRKELRKRLVLEEWIVEQLGQLYGCEEEEMPEVEIDIDDLLDADSDEERASKLQEALVDCYKPTEEFIKELLSRIRGMRKLSPPQKKSV

SEQ ID NO: 59891 - protein, 145 aa, Homo sapiens
MLSSSPASCTSPSPDGENPCKKVHWASGRRRTSSTDSESKSHPDSSKIPRSRRPSRLTVKYDRGQLQRWLEMEQWVDAQVQELFQDQATPSEPEIDLEALMDLSTEEQKTQLEAILGNCPRPTEAFISELLSQLKKLRRLSRPQK

SEQ ID NO: 59892 - protein, 200 aa, Homo sapiens
MLSSSPASCTSPSPDGENPCKKVHWASGRRRTSSTDSESKSHPDSSKIPRSRRPSRLTVKYDRGQLQRWLEMEQWVDAQVQELFQSLALSPRLECSGVIHSLQLLPPGFNRFSCLSSWSSWDYGIKQPLLSLRLTWKLSWIYPQRSRRLSWRPFLGTAPAPQRLLSLSCSVNSRNSGDSAGLRNKPERPSLAASALPGLP

SEQ ID NO: 59893 - protein, 171 aa, Homo sapiens
MEQDNSPRKIQFTVPLLEPHLDPEAAEQIRRRRPTPATLVLTSDQSSPEIDEDRIPNPHLKSTLAMSPRQRKKMTRITPTMKELQMMVEHHLGQQQQGEEPEGAAESTETQESRPPGIPDTEVESRLGTSGTAKKTAECIPKTHERGSKEPSTKEPSTHIPPLDSKGANSV

SEQ ID NO: 59894 - protein, 153 aa, Homo sapiens
MEQDNSPRKIQFTVPLLEPHLDPEAAEQIRRRRPTPATLVLTSDQSSPEIDEDRIPNPHLKKLQNASLKLTREAVRNPAQKNPQPIYHHWIPREPTRCHRRGGTGGQKSVGGFPCSTHTLAPFYVFTRSILLLKRGERMSHPLEPRDDPTKMP

SEQ ID NO: 59895 - protein, 109 aa, Homo sapiens
MEPNSPKKIQFAVPVFQSQIAPEAAEQIRKRRPTPASLVILNEHNPPEIDDKRGPNTQGELQNASPKQRKQSVYTPPTIKGVKHLKGQNESAFPEEEEGTNEREEQRDH

SEQ ID NO: 59896 - protein, 109 aa, Homo sapiens; identical to SEQ ID NO: 59895

SEQ ID NO: 59897 - protein, 109 aa, Homo sapiens; identical to SEQ ID NO: 59895

SEQ ID NO: 59898 - protein, 205 aa, Homo sapiens
MAASTASHRPIKGILKNKTSTTSSMVASAEQPRGNVDEELSKKSQKWDEMNILATYHPADKDYGLMKIDEPSTPYHSMMGDDEDACSDTEATEAMAPDILARKLAAAEGLEPKYRIQEQESSGEEDSDLSPEEREKKRQFEMKRKLHYNEGLNIKLARQLISKDLHDDDEDEEMLETADGESMNTEESNQGSTPSDQQQNKLRSS

SEQ ID NO: 59899 - protein, 1030 aa, Homo sapiens
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 59900 - protein, 971 aa, Homo sapiens
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQVNTITLYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 59901 - protein, 974 aa, Homo sapiens
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQVNTITLYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 59902 - protein, 995 aa, Homo sapiens
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQVNTITLYETSSTSAGDRYDSLLGRSGSYSYLEERKPYSSRLEKDDSTDFKKRQERFADRSLLEMEKRERRALERRISEMEEELKMLPDLKADNQRLKDENGALIRVISKLSK

SEQ ID NO: 59903 - protein, 995 aa, Homo sapiens
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKRQERFADRSLLEMEKRERRALERRISEMEEELKMLPDLKADNQRLKDENGALIRVISKLSK

SEQ ID NO: 59904 - protein, 1030 aa, Homo sapiens; identical to SEQ ID NO: 59899

SEQ ID NO: 59905 - protein, 1030 aa, Homo sapiens
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQVNTITLYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 59906 - protein, 943 aa, Homo sapiens
MVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSCSFGRRQDDLISSSVPSTTSTPTVTSAAGLQKSLLSSTSTTTKITTGSSSAGTQSSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 59907 - protein, 974 aa, Homo sapiens
MKMADAKQKRNEQLKRWIGSETDLEPPVVKRQKTKVKFDDGAVFLAACSSGDTDEVLKLLHRGADINYANVDGLTALHQACIDDNVDMVKFLVENGANINQPDNEGWIPLHAAASCGYLDIAEFLIGQGAHVGAVNSEGDTPLDIAEEEAMEELLQNEVNRQGVDIEAARKEEERIMLRDARQWLNSGHINDVRHAKSGGTALHVAAAKGYTEVLKLLIQAGYDVNIKDYDGWTPLHAAAHWGKEEACRILVDNLCDMEMVNKVGQTAFDVADEDILGYLEELQKKQNLLHSEKRDKKSPLIESTANMDNNQSQKTFKNKETLIIEPEKNASRIESLEQEKVDEEEEGKKDESSCSSEEDEEDDSESEAETDKTKPLASVTNANTSSTQAAPVAVTTPTVSSGQATPTSPIKKFPTTATKISPKEEERKDESPATWRLGLRKTGSYGALAEITASKEGQKEKDTAGVTRSASSPRLSSSLDNKEKEKDSKGTRLAYVAPTIPRRLASTSDIEEKENRDSSSLRTSSSYTRRKWEDDLKKNSSVNEGSTYHKSTSNRLWAEDSTEKEKDSVPTAVTIPVAPTVVNAAASTTTLTTTTAGTVSSTTEVRERRRSYLTPVRDEESESQRKARSRQARQSRRSTQGVTLTDLQEAEKTIGRSRSTRTREQENEEKEKEEKEKQDKEKQEEKKESETSREDEYKQKYSRTYDETYQRYRPVSTSSSTTPSSSLSTMSSSLYASSQLNRPNSLVGITSAYSRGITKENEREGEKREEEKEGEDKSQPKSIRERRRPREKRRSTGVSFWTQDSDENEQEQQSDTEEGSNKKETQTDSISRYETSSTSAGDRYDSLLGRSGSYSYLEERKPYSSRLEKDDSTDFKKLYEQILAENEKLKAQLHDTNMELTDLKLQLEKATQRQERFADRSLLEMEKRERRALERRISEMEEELKMLPDLKADNQRLKDENGALIRVISKLSK

SEQ ID NO: 59908 - protein, 982 aa, Homo sapiens
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAEYFINHGASVGIVNSEGEVPSDLAEEPAMKDLLLEQVKKQGVDLEQSRKEEEQQMLQDARQWLNSGKIEDVRQARSGATALHVAAAKGYSEVLRLLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEADKKPEAFVNHSNSESKSSITEQIPAPAQNTFSASSARRFSSGLFNKPEEPKDESPSSWRLGLRKTGSHNMLSEVANSREPIRDRGSSIYRSSSSPRISALLDNKDKERENKSYISSLAPRKLNSTSDIEEKENRESAVNLVRSGSYTRQLWRDEAKGNEIPQTIAPSTYVSTYLKRTPHKSQADTTAEKTADNVSSSTPLCVITNRPLPSTANGVTATPVLSITGTDSSVEAREKRRSYLTPVRDEEAESLRKARSRQARQTRRSTQGVTLTDLQEAERTFSRSRAERQAQEQPREKPTDTEGLEGSPEKHEPSAVPATEAGEGQQPWGRSLDEEPICHRLRCPAQPDKPTTPASPSTSRPSLYTSSHLLWTNRFSVPDSESSETTTNTTTAKEMDKNENEEADLDEQSSKRLSIRERRRPKERRRGTGINFWTKDEDETDGSEEVKETWAERLKRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKVLTELKSDNQRLKDENGALIRVISKLSK

SEQ ID NO: 59909 - protein, 386 aa, Homo sapiens
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAEYFINHGASVGIVNSEGEVPSDLAEEPAMKDLLLEQVKKQGVDLEQSRKEEEQQMLQDARQWLNSGKIEDVRQARSGATALHVAAAKGYSEVLRLLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEAVLFWPF

SEQ ID NO: 59910 - protein, 224 aa, Homo sapiens
MDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKNLHQLKQIQTLKQMNEQLQAENRALTRVVARLSESIESSDTQEL

SEQ ID NO: 59911 - protein, 208 aa, Homo sapiens
MDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKVLTELKSDNQRLKDENGALIRVISKLSK

SEQ ID NO: 59912 - protein, 982 aa, Homo sapiens
MAELEHLGGKRAESARMRRAEQLRRWRGSLTEQEPAERRGAGRQPLTRRGSPRVRFEDGAVFLAACSSGDTDEVRKLLARGADINTVNVDGLTALHQACIDENLDMVKFLVENRANVNQQDNEGWTPLHAAASCGYLNIAEYFINHGASVGIVNSEGEVPSDLAEEPAMKDLLLEQVKKQGVDLEQSRKEEEQQMLQDARQWLNSGKIEDVRQARSGATALHVAAAKGYSEVLRLLIQAGYELNVQDYDGWTPLHAAAHWGVKEACSILAEALCDMDIRNKLGQTPFDVADEGLVEHLELLQKKQNVLRSEKETRNKLIESDLNSKIQSGFFKNKEKMLYEEETPKSQEMEEENKESSSSSSEEEEGEDEASESETEKEADKKPEAFVNHSNSESKSSITEQIPAPAQNTFSASSARRFSSGLFNKPEEPKDESPSSWRLGLRKTGSHNMLSEVANSREPIRDRGSSIYRSSSSPRISALLDNKDKERENKSYISSLAPRKLNSTSDIEEKENRESAVNLVRSGSYTRQLWRDEAKGNEIPQTIAPSTYVSTYLKRTPHKSQADTTAEKTADNVSSSTPLCVITNRPLPSTANGVTATPVLSITGTDSSVEAREKRRSYLTPVRDEEAESLRKARSRQARQTRRSTQGVTLTDLQEAERTFSRSRAERQAQEQPREKPTDTEGLEGSPEKHEPSAVPATEAGEGQQPWGRSLDEEPICHRLRCPAQPDKPTTPASPSTSRPSLYTSSHLLWTNRFSVPDSESSETTTNTTTAKEMDKNENEEADLDEQSSKRLSIRERRRPKERRRGTGINFWTKDEDETDGSEEVKETWHERLSRLESGGSNPTTSDSYGDRASARARREAREARLATLTSRVEEDSNRDYKKLYESALTENQKLKTKLQEAQLELADIKSKLEKVAQQKQEKTSDRSSVLEMEKRERRALERKMSEMEEEMKVLTELKSDNQRLKDENGALIRVISKLSK

SEQ ID NO: 59913 - protein, 782 aa, Homo sapiens
MSGEDGPAAGPGAAAAAARERRREQLRQWGARAGAEPGPGERRARTVRFERAAEFLAACAGGDLDEARLMLRAADPGPGAELDPAAPPPARAVLDSTNADGISALHQACIDENLEVVRFLVEQGATVNQADNEGWTPLHVAASCGYLDIARYLLSHGANIAAVNSDGDLPLDLAESDAMEGLLKAEIARRGVDVEAAKRAEEELLLHDTRCWLNGGAMPEARHPRTGASALHVAAAKGYIEVMRLLLQAGYDPELRDGDGWTPLHAAAHWGVEDACRLLAEHGGGMDSLTHAGQRPCDLADEEVLSLLEELARKQEDLRNQKEASQSRGQEPQAPSSSKHRRSSVCRLSSREKISLQDLSKERRPGGAGGPPIQDEDEGEEGPTEPPPAEPRTLNGVSSPPHPSPKSPVQLEEAPFSRRFGLLKTGSSGALGPPERRTAEGAPGAGLQRSASSSWLEGTSTQAKELRLARITPTPSPKLPEPSVLSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQRAEAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 59914 - protein, 719 aa, Homo sapiens
MSGEDGPAAGPGAAAAAARERRREQLRQWGARAGAEPGPGERRARTVRFERAAEFLAACAGGDLDEARLMLRAADPGPGAELDPAAPPPARAVLDSTNADGISALHQACIDENLEVVRFLVEQGATVNQADNEGWTPLHVAASCGYLDIARYLLSHGANIAAVNSDGDLPLDLAESDAMEGLLKAEIARRGVDVEAAKRAEEELLLHDTRCWLNGGAMPEARHPRTGASALHVAAAKGYIEVMRLLLQAGYDPELRDGDGWTPLHAAAHWGVEDACRLLAEHGGGMDSLTHAGQRPCDLADEEVLSLLEELARKQEDLRNQKEASQSRGQEPQAPSSSKHRRSSVCRLSSREKISLQDLSKERRPGGAGGPPIQDEDEGEEGPTEPPPAEPRTLNGVSSPPHPSPKSPVQLEEAPFSRRFGLLKTGSSGALGPPERRTAEGAPGAGLQRSASSSWLEGTSTQAKELRLARITPTPSPKLPEPSVLSEVTKPPPCLENSSPPSRIPEPESPAKPNVPTASTAPPADSRDRRRSYQMPVRDEESESQRKARSRLMRQSRRSTQGVTLTDLKEAEKAGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 59915 - protein, 707 aa, Homo sapiens
MRNGGPCQPLAAGPRAEGASVNWSVTAWGPGTQACIDENLEVVRFLVEQGATVNQADNEGWTPLHVAASCGYLDIARYLLSHGANIAAVNSDGDLPLDLAESDAMEGLLKAEIARRGVDVEAAKRAEEELLLHDTRCWLNGGAMPEARHPRTGASALHVAAAKGYIEVMRLLLQAGYDPELRDGDGWTPLHAAAHWGVEDACRLLAEHGGGMDSLTHAGQRPCDLADEEVLSLLEELARKQEDLRNQKEASQSRGQEPQAPSSSKHRRSSVCRLSSREKISLQDLSKERRPGGAGGPPIQDEDEGEEGPTEPPPAEPRTLNGVSSPPHPSPKSPVQLEEAPFSRRFGLLKTGSSGALGPPERRTAEGAPGAGLQRSASSSWLEGTSTQAKELRLARITPTPSPKLPEPSVLSEVTKPPPCLENSSPPSRIPEPESPAKPNVPTASTAPPADSRDRRRSYQMPVRDEESESQRKARSRLMRQSRRSTQGVTLTDLKEAEKAAGKAPESEKPAQSLDPSRRPRVPGVENSDSPAQREAPDGQGPGPQAAREHRKVGKEWRGPAEGEEAEPADRSQESSTLEGGPSARRQRWQRDLNPEPEPESEEPDGGFRTLYAELRRENERLREALTETTLRLAQLKVELERATQRQERFAERPALLELERFERRALERKAAELEEELKALSDLRADNQRLKDENAALIRVISKLSK

SEQ ID NO: 59916 - protein, 713 aa, Homo sapiens
MEPGTGGSRKRLGPRAGFRFWPPFFPRRSQAGSSKFPTPLGPENSGNPTLLSSAQPETRVSYWTKLLSQLLAPLPGLLQKVLIWSQLFGGMFPTRWLDFAGVYSALRALKGREKPAAPTAQKSLSSLQLDSSDPSVTSPLDWLEEGIHWQYSPPDLKLELKAKGSALDPAAQAFLLEQQLWGVELLPSSLQSRLYSNRELGSSPSGPLNIQRIDNFSVVSYLLNPSYLDCFPRLEVSYQNSDGNSEVVGFQTLTPESSCLREDHCHPQPLSAELIPASWQGCPPLSTEGLPEIHHLRMKRLEFLQQANKGQDLPTPDQDNGYHSLEEEHSLLRMDPKHCRDNPTQFVPAAGDIPGNTQESTEEKIELLTTEVPLALEEESPSEGCPSSEIPMEKEPGEGRISVVDYSYLEGDLPISARPACSNKLIDYILGGASSDLETSSDPEGEDWDEEAEDDGFDSDSSLSDSDLEQDPEGLHLWNSFCSVDPYNPQNFTATIQTAARIVPEEPSDSEKDLSGKSDLENSSQSGSLPETPEHSSGEEDDWESSADEAESLKLWNSFCNSDDPYNPLNFKAPFQTSGENEKGCRDSKTPSESIVAISECHTLLSCKVQLLGSQESECPDSVQRDVLSGGRHTHVKRKKVTFLEEVTEYYISGDEDRKGPWEEFARDGCRFQKRIQETEDAIGYCLTFEHRERMFNRLQGTCFKGLNVLKQC

SEQ ID NO: 59917 - protein, 623 aa, Homo sapiens [sequence omitted]

SEQ ID NO: 59918 - protein, 567 aa, Homo sapiens
MASHVDLLTELQLLEKVPTLERLRAAQKRRAQQLKKWAQYEQDLQHRKRKHERKRSTGGRRKKVSFEASVALLEASLRNDAEEVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLLHIAGANGYLRAAELLLDHGVRVDVKDWDGWEPLHAAAFWGQMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 59919 - protein, 525 aa, Homo sapiens
MASHVDLLTELQLLEKVPTLERLRAAQKRRAQQLKKWAQYEQDLQHRKRKHERKRSTGGRRKKVSFEASVALLEASLRNDAEEVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLMQMAELLVSHGASLSARTSMDEMPIDLCEEEEFKVLLLELKHKHDVIMKSQLRHKSSLSRRTSSAGSRGKVVRRASLSDRTNLYRKEYEGEAILWQRSAAEDQRTSTYNGDIRETRTDQENKDPNPRLEKPVLLSEFPTKIPRGELDMPVENGLRAPVSAYQYALANGDVWKVHEVPDYSMAYGNPGVADATPPWSSYKEQSPQTLLELKRQRAAAKLLSHPFLSTHLGSSMARTGESSSEGKAPLIGGRTSPYSSNGTSVYYTVTSGDPPLLKFKAPIEEMEEKVHGCCRIS

SEQ ID NO: 59920 - protein, 1122 aa, Homo sapiens
MEPSEVPSQISKDNFLEVPNLSDSLCEDEEVTFQPGFSPQPSRRGSDSSEDIYLDTPSSGTRRVSFADSFGFNLVSVKEFDCWELPSASTTFDLGTDIFHTEEYVLAPLFDLPSSKEDLMQQLQIQKAILESTESLLGSTSIKGIIRVLNVSFEKLVYVRMSLDDWQTHYDILAEYVPNSCDGETDQFSFKIVLVPPYQKDGSKVEFCIRYETSVGTFWSNNNGTNYTFICQKKEQEPEPVKPWKEVPNRQIKGCLKVKSSKEESSVTSEENNFENPKNTDTYIPTIICSHEDKEDLEASNRNVKDVNREHDEHNEKELELMINQHLIRTRSTASRDERNTFSTDPVNFPNKAEGLEKKQIHGEICTDLFQRSLSPSSSAESSVKGDFYCNEKYSSGDDCTHQPSEETTSNMGEIKPSLGDTSSDELVQLHTGSKEVLDDNANPAHGNGTVQIPCPSSDQLMAGNLNKKHEGGAKNIEVKDLGCLRRDFHSDTSACLKESTEEGSSKEDYYGNGKDDEEQRIYLGVNEKQRKNFQTILHDQERKMGNPKISVAGIGASNRDLATLLSEHTAIPTRAITADVSHSPRTNLSWEEAVLTPEHHHLTSEGSALGGITGQVCSSRTGNVLRNDYLFQVEEKSGGINSEDQDNSPQHKQSWNVLESQGKSRENKTNITEHIKGQTDCEDVWGKRDNTRSLKATTEELFTCQETVCCELSSLADHGITEKAEAGTAYIIKTTSESTPESMSAREKAIIAKLPQETARSDRPIEVKETAFDPHEGRNDDSHYTLCQRDTVGVIYDNDFEKESRLGICNVRVDEMEKEETMSMYNPRKTHDREKCGTGNITSVEESSWVITEYQKATSKLDLQLGMLPTDKTVFSENRDLRQVQELSKKTDSDAIVHSAFNSDTNRAPQNSSPFSKHHTEISVSTNEQAIAVENAVTTMASQPISTKSENICNSTREIQGIEKHPYPESKPEEVSRSSGIVTSGSRKERCIGQIFQTEEYSVEKSLGPMILINKPLENMEEARHENEGLVSSGQSLYTSGEKESDSSASTSLPVEESQAQGNESLFSKYTNSKIPYFLLFLIFLITVYHYDLMIGLTFYVLSLSWLSWEEGRQKESVKKK

SEQ ID NO: 59921 - protein, 317 aa, Homo sapiens
MSCTRMIQVLDPRPLTSSVMPVDVAMRLCLAHSPPVKSFLGPYDEFQRRHFVNKLKPLKSCLNIKHKAKSQNDWKCSHNQAKKRVVFADSKGLSLTAIHVFSDLPEEPAWDLQFDLLDLNDISSALKHHEEKNLILDFPQPSTDYLSFRSHFQKNFVCLENCSLQERTVTGTVKVKNVSFEKKVQIRITFDSWKNYTDVDCVYMKNVYGGTDSDTFSFAIDLPPVIPTEQKIEFCISYHANGQVFWDNNDGQNYRIVHVQWKPDGVQTQMAPQDCAFHQTSPKTELESTIFGSPRLASGLFPEWQSWGRMENLASYR

SEQ ID NO: 59922 - protein, 297 aa, Homo sapiens
MSCTRMIQVLDPRPLTSSVMPVDVAMRLCLAHSPPVKSFLGPYDEFQRRHFVNKLKPLKSCLNIKHKAKSQNDWKCSHNQAKKRVVFADSKGLSLTAIHVFSDLPEEPAWDLQFDLLDLNDISSALSFRSHFQKNFVCLENCSLQERTVTGTVKVKNVSFEKKVQIRITFDSWKNYTDVDCVYMKNVYGGTDSDTFSFAIDLPPVIPTEQKIEFCISYHANGQVFWDNNDGQNYRIVHVQWKPDGVQTQMAPQDCAFHQTSPKTELESTIFGSPRLASGLFPEWQSWGRMENLASYR

SEQ ID NO: 59923 - protein, 199 aa, Homo sapiens
MSSPTSPLKHHEEKNLILDFPQPSTDYLSFRSHFQKNFVCLENCSLQERTVTGTVKVKNVSFEKKVQIRITFDSWKNYTDVDCVYMKNVYGGTDSDTFSFAIDLPPVIPTEQKIEFCISYHANGQVFWDNNDGQNYRIVHVQWKPDGVQTQMAPQDCAFHQTSPKTELESTIFGSPRLASGLFPEWQSWGRMENLASYR

SEQ ID NO: 59924 - protein, 299 aa, Homo sapiens
MSRGPSSAVLPSALGSRKLGPRSLSCLSDLDGGVALEPRACRPPGSPGRAPPPTPAPSGCDPRLRPIILRRARSLPSSPERRQKAAGAPGAACRPGCSQKLRVRFADALGLELAQVKVFNAGDDPSVPLHVLSRLAINSDLCCSSQDLEFTLHCLVPDFPPPVEAADFGERLQRQLVCLERVTCSDLGISGTVRVCNVAFEKQVAVRYTFSGWRSTHEAVARWRGPAGPEGTEDVFTFGFPVPPFLLELGSRVHFAVRYQVAGAEYWDNNDHRDYSLTCRNHALHMPRGECEESWIHFI

SEQ ID NO: 59925 - protein, 360 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 59926 - protein, 317 aa, Homo sapiens
MAAERGAGQQQSQEMMEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNNKLTMLDIASNRIKKIENISHLTELQEFWMNDNLLESWSDLDELKGARSLETVYLERNPLQKDPQYRRKVMLALPSVRQIDATFVRF

SEQ ID NO: 59927 - protein, 237 aa, Homo sapiens
MAAERGAGQQQSQEMMEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 59928 - protein, 280 aa, Homo sapiens
MAAERGAGQQQSQEMMEVDRRVESEESGDEEGKKHSSGIVADLSEQSLKDGEERGEEDPEEEHELPVDMETINLDRDAEDVDLNHYRIGKIEGFEVLKKVKTLCLRQNLIKCIENLEELQSLRELDLYDNQIKKIENLEALTELEILDISFNLLRNIEGVDKLTRLKKLFLVNNKISKIENLSNLHQLQMLELGSNRIRAIENIDTLTNLESLFLGKNKITKLQNLDALTNLTVLSMQSNRLTKIEGLQNLVNLRELYLSHNGIEVIEGLENNVQDSLTY

SEQ ID NO: 59929 - protein, 360 aa, Homo sapiens; identical to SEQ ID NO: 59925

SEQ ID NO: 59930 - protein, 127 aa, Homo sapiens
MVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 59931 - protein, 351 aa, Homo sapiens
MAAAANSGSSLPLFDCPTWAGKPPPGLHLDVVKGDKLIEKLIIDEKKYYLFGRNPDLCDFTIDHQSCSRVHAALVYHKHLKRVFLIDLNSTHGTFLGHIRLEPHKPQQIPIDSTVSFGASTRAYTLREKPQTLPSAVKGDEKMGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 59932 - protein, 209 aa, Homo sapiens
MGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTPSLLI

SEQ ID NO: 59933 - protein, 236 aa, Homo sapiens
MGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGCEFVSQSLIATAIWKCLLKAQSLGLGGNAPSPLYYK

SEQ ID NO: 59934 - protein, 205 aa, Homo sapiens
MGGEDDELKGLLGLPEEETELDNLTEFNTAHNKRISTLTIEEGNLDIQRPKRKRKNSRVTFSEDDEIINPEDVDPSVGRFRNMVQTAVVPVKKKRVEGPGSLGLEESGSRRMQNFAFSGGLYGGLPPTHSEAGSQPHGIHGTALIGGLPMPYPNLAPDVDLTPVVPSAVNMNPAPNPAVYNPEAVNEPKKKKYAKEAWPGKKPTP

SEQ ID NO: 59935 - protein, 199 aa, Homo sapiens
MAAAANSGSSLPLFDCPTWAGKPPPGLHLDVVKGDKLIEKLIIDEKKYYLFGRNPDLCDFTIDHQSCSRVHAALVYHKHLKRVFLIDLNSTHGTFLGHIRLEPHKPQQIPIDSTVSFGASTRAYTLREKPQTLPSAVKGDEKMGGEDDELKGLLGLPEEETELDNLTEFNTAHNHMASMGQHSSVACPCHTQTLPLMWT

SEQ ID NO: 59936 - protein, 1296 aa, Homo sapiens
MLKTESSGERTTLRSASPHRNAYRTEFQALKSTFDKPKSDGEQKTKEGEGSQQSRGRKYGSNVNRIKNLFMQMGMEPNENAAVIAKTRGKGGHSSPQRRMKPKEFLEKTDGSVVKLESSVSERISRFDTMYDGPSYSKFTETRKMFERSVHESGQNNRYSPKKEKAGGSEPQDEWGGSKSNRGSTDSLDSLSSRTEAVSPTVSQLSAVFENTDSPSAIISEKAENNEYSVTGHYPLNLPSVTVTNLDTFGHLKDSNSWPPSNKRGVDTEDAHKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKNFTFNDDFSPSSTSSADLSGLGAEPKTPGLSQSLALSSDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 59937 - protein, 1098 aa, Homo sapiens
MLKTESSGERTTLRSASPHRNAYRTEFQALKSTFDKPKSDGEQKTKEGEGSQQSRGRKYGSNVNRIKNLFMQMGMEPNENAAVIAKTRGKGGHSSPQRRMKPKEFLEKTDGSVVKLESSVSERISRFDTMYDGPSYSKFTETRKMFERSVHESGQNNRYSPKKEKAGGSEPQDEWGGSKSNRGSTDSLDSLSSRTEAVSPTVSQLSAVFENTDSPSAIISEKAENNEYSVTGHYPLNLPSVTVTNLDTFGHLKDSNSWPPSNKRGVDTEDAHKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKNFTFNDDFSPSSTSSADLSGLGAEPKTPGLSQSLALSSDESLDMIDDEILDDGQSPKHSQCQNRAVQEWSVQQVSHWLMSLNLEQYVSEFSAQNITGEQLLQLDGNKLKALGMTASQDRAVVKKKLKEMKMSLEKARKAQEKMEKQREKLRRKEQEQMQRKSKKTEKMTSTTAEGAGEQ

SEQ ID NO: 59938 - protein, 73 aa, Homo sapiens
MLKTESSGERTTLRSASPHRNAYRTEFQALKSTFDKPKSDGEQKTKEGEGSQQSRGRKYGSNVNRIKNLFMQM

SEQ ID NO: 59939 - protein, 41 aa, Homo sapiens
MLKTESSGERTTLRSASPHRNAYRTEFQALKSTFDKPKSDG

SEQ ID NO: 59940 - protein, 1098 aa, Homo sapiens; identical to SEQ ID NO: 59937

SEQ ID NO: 59941 - protein, 1253 aa, Homo sapiens
MLKTESSGERTTLRSASPHRNAYRTEFQALKSTFDKPKSDGEQKTKEGEGSQQSRGRKYGSNVNRIKNLFMQMGMEPNENAAVIAKTRGKGGHSSPQRRMKPKEFLEKTDGSVVKLESSVSERISRFDTMYDGPSYSKFTETRKMFERSVHESGQNNRYSPKKEKAGGSEPQDEWGGSKSNRGSTDSLDSLSSRTEAVSPTVSQLSAVFENTDSPSAIISEKAENNEYSVTGHYPLNLPSVTVTNLDTFGHLKDSNSWPPSNKRGVDTEDAHKSNATPVPEVASKSTSLASIPGEEIQQSKEPEDSTSNQQTPDSIDKDGPEEPCAESKAMPKSEIPSPQSQLLEDAEANLVGREAAKQQRKELAGGDFTSPDASASSCGKEVPEDSNNFDGSHVYMHSDYNVYRVRSRYNSDWGETGTEQDEEEDSDENSYYQPDMEYSEIVGLPEEEEIPANRKIKFSSAPIKVFNTYSNEDYDRRNDEVDPVAASAEYELEKRVEKLELFPVELEKDEDGLGISIIGMGVGADAGLEKLGIFVKTVTEGGAAQRDGRIQVNDQIVEVDGISLVGVTQNFAATVLRNTKGNVRFVIGREKPGQVSEVAQLISQTLEQERRQRELLEQHYAQYDADDDETGEYATDEEEDEVGPVLPGSDMAIEVFELPENEDMFSPSELDTSKLSHKFKELQIKHAVTEAEIQKLKTKLQAAENEKVRWELEKTQLQQNIEENKERMLKLESYWIEAQTLCHTVNEHLKETQSQYQALEKKYNKAKKLIKDFQQKELDFIKRQEAERKKIEDLEKAHLVEVQGLQVRIRDLEAEVFRLLKQNGTQVNNNNNIFERRTSLGEVSKGDTMENLDGKQTSCQDGLSQDLNEAVPETERLDSKALKTRAQLSVKNRRQRPSRTRLYDSVSSTDGEDSLERKPSNSFYNHMHITKLLPPKGLRTSSPESDSGVPPLTPVDSNVPFSSDHIAEFQEEPLDPEMGPLSSMWGDTSLFSTSKSDHDVEESPCHHQTTNKKILREKDDAKDPKSLRASSSLAVQGGKIKRKFVDLGAPLRRNSSKGKKWKEKEKEASRFSAGSRIFRGRLENWTPKPCSTAQTSTRSPCMPFSWFNDSRKGSYSFRNLPAPTSSLQPSPETLISDKKGSKNFTFNDDFSPSSTSSADLSGLGAEPKTPGLSQSLALSSDEALGMTASQDRAVVKKKLKEMKMSLEKARKAQEKMEKQREKLRRKEQEQMQRKSKKTEKMTSTTAEGAGEQ

SEQ ID NO: 59942 - protein, 309 aa, Homo sapiens
MDEKVFTKELDQWIEQLNECKQLSESQVKSLCEKAKEILTKESNVQEVRCPVTVCGDVHGQFHDLMELFRIGGKSPDTNYLFMGDYVDRGYYSVETVTLLVALKVRYRERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 59943 - protein, 309 aa, Homo sapiens
MDDKAFTKELDQWVEQLNECKQLNENQVRTLCEKAKEILTKESNVQEVRCPVTVCGDVHGQFHDLMELFRIGGKSPDTNYLFMGDYVDRGYYSVETVTLLVALKVRYPERITILRGNHESRQITQVYGFYDECLRKYGNANVWKYFTDLFDYLPLTALVDGQIFCLHGGLSPSIDTLDHIRALDRLQEVPHEGPMCDLLWSDPDDRGGWGISPRGAGYTFGQDISETFNHANGLTLVSRAHQLVMEGYNWCHDRNVVTIFSAPNYCYRCGNQAAIMELDDTLKYSFLQFDPAPRRGEPHVTRRTPDYFL

SEQ ID NO: 59944 - protein, 309 aa, Homo sapiens; identical to SEQ ID NO: 59943

SEQ ID NO: 59945 - protein, 486 aa, Homo sapiens
MSSSSPPAGAASAAISASEKVDGFTRKSVRKAQRQKRSQGSSQFRSQGSQAELHPLPQLKDATSNEQQELFCQKLQQCCILFDFMDSVSDLKSKEIKRATLNELVEYVSTNRGVIVESAYSDIVKMISANIFRTLPPSDNPDFDPEEDEPTLEASWPHIQLVYEFFLRFLESPDFQPSIAKRYIDQKFVQQLLELFDSEDPRERDFLKTVLHRIYGKFLGLRAFIRKQINNIFLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 59946 - protein, 429 aa, Homo sapiens
MIMNATSNEQQELFCQKLQQCCILFDFMDSVSDLKSKEIKRATLNELVEYVSTNRGVIVESAYSDIVKMISANIFRTLPPSDNPDFDPEEDEPTLEASWPHIQLVYEFFLRFLESPDFQPSIAKRYIDQKFVQQLLELFDSEDPRERDFLKTVLHRIYGKFLGLRAFIRKQINNIFLRFIYETEHFNGVAELLEILGSIINGFALPLKAEHKQFLMKVLIPMHTAKGLALFHAQLAYCVVQFLEKDTTLTEPVIRGLLKFWPKTCSQKEVMFLGEIEEILDVIEPTQFKKIEEPLFKQISKCVSSSHFQVAERALYFWNNEYILSLIEENIDKILPIMFASLYKISKEHWNPTIVALVYNVLKTLMEMNGKLFDDLTSSYKAERQREKKKELEREELWKKLEELKLKKALEKQNSAYNMHSILSNTSAE

SEQ ID NO: 59947 - protein, 486 aa, Homo sapiens; identical to SEQ ID NO: 59945

SEQ ID NO: 59948 - protein, 446 aa, Homo sapiens
MKCFSRYLPYIFRPPNTILSSSCHTEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 59949 - protein, 443 aa, Homo sapiens
MEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 59950 - protein, 501 aa, Homo sapiens
MVLQPSERHYRDWNHRRLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 59951 - protein, 432 aa, Homo sapiens
MNYPDENTYGNKADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 59952 - protein, 443 aa, Homo sapiens; identical to SEQ ID NO: 59949

SEQ ID NO: 59953 - protein, 443 aa, Homo sapiens; identical to SEQ ID NO: 59949

SEQ ID NO: 59954 - protein, 509 aa, Homo sapiens
MLLSLPALHLQTSEHHPFFQLPHRRLGPWCSPTGSPAPLSCETGCGEGSWILVCRLLVPTQVSLLSMEEDIDTRKINNSFLRDHSYATEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 59955 - protein, 443 aa, Homo sapiens; identical to SEQ ID NO: 59949

SEQ ID NO: 59956 - protein, 449 aa, Homo sapiens
MIPGIGTLTQDTLWCFSQVKGTIEIGTTEADIISTVEFNHTGELLATGDKGGRVVIFQREQESKNQVHRRGEYNVYSTFQSHEPEFDYLKSLEIEEKINKIRWLPQQNAAYFLLSTNDKTVKLWKVSERDKRPEGYNLKDEEGRLRDPATITTLRVPVLRPMDLMVEATPRRVFANAHTYHINSISVNSDYETYMSADDLRINLWNFEITNQSFNIVDIKPANMEELTEVITAAEFHPHHCNTFVYSSSKGTIRLCDMRASALCDRHTKFFEEPEDPSNRSFFSEIISSISDVKFSHSGRYIMTRDYLTVKVWDLNMENRPIETYQVHDYLRSKLCSLYENDCIFDKFECVWNGSDSVIMTGSYNNFFRMFDRNTKRDVTLEASRENSKPRAILKPRKVCVGGKRRKDEISVDSLDFSKKILHTAWHPSENIIAVAATNNLYIFQDKVN

SEQ ID NO: 59957 - protein, 432 aa, Homo sapiens; identical to SEQ ID NO: 59951

SEQ ID NO: 59958 - protein, 497 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHKQFLVRVLIPLHSVKSLSVFHAQLAYCVVQFLEKDATLTEHVIRGLLKYWPKTCTQKEVMFLGEMEEILDVIEPSQFVKIQEPLFKQVARCVSSPHFQVAERALYFWNNEYILSLIEDNCHTVLPAVFGTLYQVSKEHWNQTIVSLIYNVLKTFMEMNGKLFDELTASYKLEKQQEQQKAQERQELWQGLEELRLRRLQGTQGAKEAPLQRLTPQVAASGGQS

SEQ ID NO: 59959 - protein, 368 aa, Homo sapiens
SVQSHPAPPRPRENPRGSESLPCRLTAMETKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQKFVLMLLELFDSEDPREREYLKTILHRVYGKFLGLRAYIRKQCNHIFLRFIYEFEHFNGVAELLEILGSIINGFALPLKTEHKPGSRPDPPALCQVAVCLPCPAGILCGAVPGEGCHSDRARDPGAAQILAKNLHPEGGDVSGGDGRDS

SEQ ID NO: 59960 - protein, 193 aa, Homo sapiens
METKLPPASTPTSPSSPGLSPVPPPDKVDGFSRRSLRRARPRRSHSSSQFRYQSNQQELTPLPLLKDVPASELHELLSRKLAQCGVMFDFLDCVADLKGKEVKRAALNELVECVGSTRGVLIEPVYPDIIRMISVNIFRTLPPSENPEFDPEEDEPNLEPSWPHLQLVYEFFLRFLESPDFQPSVAKRYVDQK

SEQ ID NO: 59961 - protein, 497 aa, Homo sapiens; identical to SEQ ID NO: 59958

SEQ ID NO: 59962 - protein, 135 aa, Homo sapiens
MEELTEVITAAEFHPHQCNVFVYSSSKGTIRLCDMRSSALCDRHSKFFEEPEDPSSRSFFSEIISSISDVKFSHSGRYMMTRDPVGEGVGPQHRAGRWRPTRSTSTCAASSALSMRTTASLTSLSVAGTVRIAPS

SEQ ID NO: 59963 - protein, 422 aa, Homo sapiens
LTADIISTVEFNYSGDLLATGDKGGRVVIFQREQENKSRPHSRGEYNVYSTFQSHEPEFDYLKSLEIEEKINKIRWLPQQNAAHFLLSTNDKTIKLWKISERDKRAEGYNLKDEDGRLRDPFRITALRVPILKPMDLMVEASPRRIFANAHTYHINSISVNSDHETYLSADDLRINLWHLEITDRSFNIVDIKPANMEELTEVITAAEFHPHQCNVFVYSSSKGTIRLCDMRSSALCDRHSKFFEEPEDPSSRSFFSEIISSISDVKFSHSGRYMMTRDYLSVKVWDLNMESRPVETHQVHEYLRSKLCSLYENDCIFDKFECCWNGSDSAIMTGSYNNFFRMFDRDTRRDVTLEASRESSKPRASLKPRKVCTGGKRRKDEISVDSLDFNKKILHTAWHPVDNVIAVAATNNLYIFQDKIN

SEQ ID NO: 59964 - protein, 570 aa, Homo sapiens
MPYKLKKEKEPPKVAKCTAKPSSSGKDGGGENTEEAQPQPQPQPQPQAQSQPPSSNKRPSNSTPPPTQLSKIKYSGGPQIVKKELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 59965 - protein, 496 aa, Homo sapiens
MPYKLKKEKELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 59966 - protein, 504 aa, Homo sapiens
  MOD_RES (1)..(1): Any amino acid
XKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 59967 - protein, 602 aa, Homo sapiens
MPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQLAYCVVQFLEKESSLTEPVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 59968 - protein, 584 aa, Homo sapiens
MPYKLKKEKEPPKVAKCTAKPSSSGKDGGGENTEEAQPQPQPQPQPQAQSQPPSSNKRPSNSTPPPTQLSKIKYSGGPQIVKKERRQSSSRFNLSKNRELQKLPALKDSPTQEREELFIQKLRQCCVLFDFVSDPLSDLKFKEVKRAGLNEMVEYITHSRDVVTEAIYPEAVTMFSVNLFRTLPPSSNPTGAEFDPEEDEPTLEAAWPHLQLVYEFFLRFLESPDFQPNIAKKYIDQKFVLALLDLFDSEDPRERDFLKTILHRIYGKFLGLRAYIRRQINHIFYRFIYETEHHNGIAELLEILGSIINGFALPLKEEHKMFLIRVLLPLHKVKSLSVYHPQVIVGLLKFWPKTHSPKEVMFLNELEEILDVIEPSEFSKVMEPLFRQLAKCVSSPHFQVAERALYYWNNEYIMSLISDNAARVLPIMFPALYRNSKSHWNKTIHGLIYNALKLFMEMNQKLFDDCTQQYKAEKQKGRFRMKEREEMWQKIEELARLNPQYPMFRAPPPLPPVYSMETETPTAEDIQLLKRTVETEAVQMLKDIKKEKVLLRRKSELPQDVYTIKALEAHKRAEEFLTASQEAL

SEQ ID NO: 59969 - protein, 467 aa, Homo sapiens
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 59970 - protein, 391 aa, Homo sapiens
MDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYKSDRQREKKKEKEREELWKKLEDLELKRGLRRDGIIPT

SEQ ID NO: 59971 - protein, 462 aa, Homo sapiens
MSSAPTTPPSVDKVDGFSRKSVRKARQKRSQSSSQFRSQGKPIELTPLPLLKDVPSSEQPELFLKKLQQCCVIFDFMDTLSDLKMKEYKRSTLNELVDYITISRGCLTEQTYPEVVRMVSCNIFRTLPPSDSNEFDPEEDEPTLEASWPHLQLVYEFFIRFLESQEFQPSIAKKYIDQKFVLQLLELFDSEDPRERDYLKTVLHRIYGKFLGLRAFIRKQINNIFLRFVYETEHFNGVAELLEILGSIINGFALPLKAEHKQFLVKVLIPLHTVRSLSLFHAQLAYCIVQFLEKDPSLTEPVIRGLMKFWPKTCSQKEVMFLGELEEILDVIEPSQFVKIQEPLFKQIAKCVSSPHFQVAERALYYWNNEYIMSLIEENSNVILPIMFSSLYRISKEHWNPAIVALVYNVLKAFMEMNSTMFDELTATYNEKKKEKEREELWKKLEDLELKRGLRRDGIIPT

SEQ ID NO: 59972 - protein, 447 aa, Homo sapiens
MGLSFFSKHLPIQEGQPWALKTPADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 59973 - protein, 447 aa, Homo sapiens
MGEDTDTRKINHSFLRDHSYVTEADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 59974 - protein, 440 aa, Homo sapiens
MREADTLRPPQLMEVSADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 59975 - protein, 440 aa, Homo sapiens; identical to SEQ ID NO: 59974

SEQ ID NO: 59976 - protein, 430 aa, Homo sapiens
MGKRDTADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFNIVDIKPANMEDLTEVITASEFHPHHCNLFVYSSSKGSLRLCDMRAAALCDKHSKLFEEPEDPSNRSFFSEIISSVSDVKFSHSGRYMLTRDYLTVKVWDLNMEARPIETYQVHDYLRSKLCSLYENDCIFDKFECAWNGSDSVIMTGAYNNFFRMFDRNTKRDVTLEASRESSKPRAVLKPRRVCVGGKRRRDDISVDSLDFTKKILHTAWHPAENIIAIAATNNLYIFQDKVNSDMH

SEQ ID NO: 59977 - protein, 540 aa, Homo sapiens
MPNKNKKEKESPKAGKSGKSSKEGQDTVESEQISVRKNSLVAVPSTVSAKIKVPVSQPIVKKDKRQNSSRFSASNNRELQKLPSLKDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 59978 - protein, 524 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 59979 - protein, 260 aa, Homo sapiens
MFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQDNTWLDIQRPEALHGDEPKAI

SEQ ID NO: 59980 - protein, 485 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQAQKDPKKDRPLARRKSELPQDPHTKKALEAHCRADELASQDGR

SEQ ID NO: 59981 - protein, 555 aa, Homo sapiens
MPNKNKKEKESPKAGKSGKSSKEGQDTVESEGTSPEEPSSPKVPPPLLPELLVLIFGGLQGRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 59982 - protein, 449 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQVLKKRIT

SEQ ID NO: 59983 - protein, 384 aa, Homo sapiens
MLTCNKAGSRMVVDAANSNGPFQPVVLLHIRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNK

SEQ ID NO: 59984 - protein, 553 aa, Homo sapiens
NKNKKEKESPKAGKSGKSSKEGQDTVESEGTSPEEPSSPKVPPPLLPELLVLIFGGLQGRDVPPADQEKLFIQKLRQCCVLFDFVSDPLSDLKWKEVKRAALSEMVEYITHNRNVITEPIYPEVVHMFAVNMFRTLPPSSNPTGAEFDPEEDEPTLEAAWPHLQLVYEFFLRFLESPDFQPNIAKKYIDQKFVLQLLELFDSEDPRERDFLKTTLHRIYGKFLGLRAYIRKQINNIFYRFIYETEHHNGIAELLEILGSIINGFALPLKEEHKIFLLKVLLPLHKVKSLSVYHPQLAYCVVQFLEKDSTLTEPVVMALLKYWPKTHSPKEVMFLNELEEILDVIEPSEFVKIMEPLFRQLAKCVSSPHFQVAERALYYWNNEYIMSLISDNAAKILPIMFPSLYRNSKTHWNKTIHGLIYNALKLFMEMNQKLFDDCTQQFKAEKLKEKLKMKEREEAWVKIENLAKANPQYTVYSQASTMSIPVAMETDGPLFEDVQMLRKTVKDEAHQAQKDPKKDRPLARRKSELPQDPHTKKALEAHCRADELASQDGR

SEQ ID NO: 59985 - protein, 358 aa, Homo sapiens
MAEGERQPPPDSSEEAPPATQNFIIPKKEIHTVPDMGKWKRSQAYADYIGFILTLNEGVKGKKLTFEYRVSEMWNEVHEEKEQAAKQSVSCDECIPLPRAGHCAPSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 59986 - protein, 329 aa, Homo sapiens
MAEGERQPPPDSSEEAPPATQNFIIPKKEIHTVPDMGKWKRSQVPFGTVAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 59987 - protein, 281 aa, Homo sapiens
MAEGERQPPPDSSEEAPPATQNFIIPKKEIHTVPDMGKWKRSQAYADYIGFILTLNEGVKGKKLTFEYRVSEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 59988 - protein, 294 aa, Homo sapiens
MAEGERQPPPDSSEEAPPATQNFIIPKKEIHTVPDMGKWKRSQAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 59989 - protein, 323 aa, Homo sapiens
MAEGERQPPPDSSEEAPPATQNFIIPKKEIHTVPDMGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAECLEKFPVIQHFKFGSLLPIHPVTSG

SEQ ID NO: 59990 - protein, 323 aa, Homo sapiens; identical to SEQ ID NO: 59989

SEQ ID NO: 59991 - protein, 263 aa, Homo sapiens
MGKWKRSQAYADYIGFILTLNEGVKGKKLTFEYRVSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAE

SEQ ID NO: 59992 - protein, 374 aa, Homo sapiens
MAEGERQPPPDSSEEAPPATQNFIIPKKEIHTVPDMGKWKRSQAYADYIGFILTLNEGVKGKKLTFEYRVSEMWNEVHEEKEQAAKQSVSCDECIPLPRAGHCAPSEAIEKLVALLNTLDRWIDETPPVDQPSRFGNKAYRTWYAKLDEEAENLVATVVPTHLAAAVPEVAVYLKESVGNSTRIDYGTGHEAAFAAFLCCLCKIGVLRVDDQIAIVFKVFNRYLEVMRKLQKTYRMEPAGSQGVWGLDDFQFLPFIWGSSQLIDHPYLEPRHFVDEKAVNENHKDYMFLECILFITEMKTGPFAEHSNQLWNISAVPSWSKVNQGLIRMYKAEASPSDTWGLGISHLGHGQSEKHQPPQPRKAAVQLCPDELGG

SEQ ID NO: 59993 - protein, 151 aa, Homo sapiens
MKTGPFAEHSNQLWNISAVPSWSKVNQGLIRMYKAEVSGGWPVCPSLLPHLVLGWGQSKRCGTWGSCFLLPHCFALNLRPAPLTLGASESPIWGMGSQRSTSHPSPEKLQSSSVLMSLEAEARTCCMGSGGDGGLPSPLSSGQRLLKARAV

SEQ ID NO: 59994 - protein, 933 aa, Homo sapiens
MADLSLLQEDLQEDADGSLDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 59995 - protein, 307 aa, Homo sapiens
MAEISDLDRQIEQLRRCELIKESEVKALCAKAREILVEESNVQRVDSPVTVCGDIHGQFYDLKELFRVGGDVPETNYLFMGDFVDRGFYSVETFLLLLALKVRYPDRITLIRGNHESRQITQVYGFYDECLRKYGSVTVWRYCTEIFDYLSLSAIIDGKIFCVHGGLSPSIQTLDQIRTIDRKQEVPHDGPMCDLLWSDPEDTTGWGVSPRGAGYLFGSDVVAQFNAANDIDMICRAHQLVMEGYKWHFNETVLTVWSAPNYCYRCGNVAAILELDEHLQKDFIIFEAAPQETRGIPSKKPVADYFL

SEQ ID NO: 59996 - protein, 470 aa, Homo sapiens
MLQVRTYLTEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIKREVICKMNWI

SEQ ID NO: 59997 - protein, 950 aa, Homo sapiens
MADLSLLQEDLQEDADGFGVDDYSSESDVIIIPSALDFVSQDEMLTPLGRLDKYAASENIFNRQMVARSLLDTLREVCDDERDCIAVLERISRLADDSEPTVRAELMEQVPHIALFCQENRPSIPYAFSKFLLPIVVRYLADQNNQVRKTSQAALLALLEQELIERFDVETKVCPVLIELTAPDSNDDVKTEAVAIMCKMAPMVGKDITERLILPRFCEMCCDCRMFHVRKVCAANFGDICSVVGQQATEEMLLPRFFQLCSDNVWGVRKACAECFMAVSCATCQEIRRTKLSALFINLISDPSRWVRQAAFQSLGPFISTFANPSSSGQYFKEESKSSEEMSVENKNRTRDQEAPEDVQVRPEDTPSDLSVSNSSVILENTMEDHAAEASGKPLGEISVPLDSSLLCTLSSESHQEAASNENDKKPGNYKSMLRPEVGTTSQDSALLDQELYNSFHFWRTPLPEIDLDIELEQNSGGKPSPEGPEEESEGPVPSSPNITMATRKELEEMIENLEPHIDDPDVKAQVEVLSAALRASSLDAHEETISIEKRSDLQDELDINELPNCKINQEDSVPLISDAVENMDSTLHYIHSDSDLSNNSSFSPDEERRTKVQDVVPQALLDQYLSMTDPSRAQTVDTEIAKHCAYSLPGVALTLGRQNWHCLRETYETLASDMQWKVRRTLAFSIHELAVILGDQLTAADLVPIFNGFLKDLDEVRIGVLKHLHDFLKLLHIDKRREYLYQLQEFLVTDNSRNWRFRAELAEQLILLLELYSPRDVYDYLRPIALNLCADKVSSVRWISYKLVSEMVKKLHAATPPTFGVDLINELVENFGRCPKWSGRQAFVFVCQTVIEDDCLPMDQFAVHLMPHLLTLANDRVPNVRVLLAKTLRQTLLEKDYFLASASCHQEAVEQTIMALQMDRDSDVKYFASIHPASTKISEDAMSTASSTY

SEQ ID NO: 59998 - protein, 361 aa, Homo sapiens
MDDFRTSAPEPRGPPNPNVEYIPFDEMKERILKIVTGFNGIPFTIQRLCELLTDPRRNYTGTDKFLRGVEKNVMVVSCVYPSSEKNNSNSLNRMNGVMFPGNSPSYTERSNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEESFMTSREMIPERKNQEKESDDALTVNEETSEENNQMEESDVSQAEKDLLHSEGSENEGPVSSSSSDCRETEELVGSNSSKTGEILSESSMENDDEATEVTDEPMEQD

SEQ ID NO: 59999 - protein, 417 aa, Homo sapiens
MDVERLQEALKDFEKRGKKEVCPVLDQFLCHVAKTGETMIQWSQFKGYFIFKLEKVMDDFRTSAPEPRGPPNPNVEYIPFDEMKERILKIVTGFNGIPFTIQRLCELLTDPRRNYTGTDKFLRGVEKNVMVVSCVYPSSEKNNSNSLNRMNGVMFPGNSPSYTERSNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEESFMTSREMIPERKNQEKESDDALTVNEETSEENNQMEESDVSQAEKDLLHSEGSENEGPVSSSSSDCRETEELVGSNSSKTGEILSESSMENDDEATEVTDEPMEQD

SEQ ID NO: 60000 - protein, 360 aa, Homo sapiens
MDVERLQEALKDFEKRGKKEVCPVLDQFLCHVAKTGETIIPFTIQRLCELLTDPRRNYTGTDKFLRGVEKNVMVVSCVYPSSEKNNSNSLNRMNGVMFPGNSPSYTERSNINGPGTPRPLNRPKVSLSAPMTTNGLPESTDSKEANLQQNEEKNHSDSSTSESEVSSVSPLKNKHPDEDAVEAEGHEVKRLRFDKEGEVRETASQTTSSEISSVMVGETEASSSSQDKDKDSRCTRQHCTEEDEEEDEEEEEESFMTSREMIPERKNQEKESDDALTVNEETSEENNQMEESDVSQAEKDLLHSEGSENEGPVSSSSSDCRETEELVGSNSSKTGEILSESSMENDDEATEVTDEPMEQD

SEQ ID NO: 60001 - protein, 371 aa, Homo sapiens
MALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQTEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 60002 - protein, 499 aa, Homo sapiens
MAMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 60003 - protein, 486 aa, Homo sapiens
MAMAEGERTECAEPPRDEPPADGALKRAEELKTQANDYFKAKDYENAIKFYSQAIELNPSNAIYYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVPHPNVKPMAYANTLLQLGMM

SEQ ID NO: 60004 - protein, 485 aa, Homo sapiens
  MOD_RES (1)..(1): Any amino acid
XMAEGERTECAEPPRDEPPADGALKRAEELKTQANDYFKAKDYENAIKFYSQAIELNPSNAIYYGNRSLAYLRTECYGYALGDATRAIELDKKYIKGYYRRAASNMALGKFRAALRDYETVVKVKPHDKDAKMKYQECNKIVKQKAFERAIAGDEHKRSVVDSLDIESMTIEDEYSGPKLEDGKVTISFMKELMQWYKDQKKLHRKCAYQILVQVKEVLSKLSTLVETTLKETEKITVCGDTHGQFYDLLNIFELNGLPSETNPYIFNGDFVDRGSFSVEVILTLFGFKLLYPDHFHLLRGNHETDNMNQIYGFEGEVKAKYTAQMYELFSEVFEWLPLAQCINGKVLIMHGGLFSEDGVTLDDIRKIERNRQPPDSGPMCDLLWSDPQPQNGRSISKRGVSCQFGPDVTKAFLEENNLDYIIRSHEVKAEGYEVAHGGRCVTVFSAPNYCDQMGNKASYIHLQGSDLRPQFHQFTAVGRPSSGS

SEQ ID NO: 60005 - protein, 158 aa, Homo sapiens
MLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 60006 - protein, 305 aa, Homo sapiens
MAPLDLDKYVEIARLCKYLPENDLKRLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 60007 - protein, 283 aa, Homo sapiens
MAPLDLDKYVEIARLCKYLPENDLKRLCDYVCDLLLEESNVQPVSTPVTVCGDIHGQGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 60008 - protein, 342 aa, Homo sapiens
MAPLDLDKYVEIARLCKYLPENDLKVSPICGLAPSGCGAPAGRPFLSPGPPPVFHFLRFLKERLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNANAWRYCTKVFDMLTVAALIDEQILCVHGGLSPDIKTLDQIRTIERNQEIPHKGAFCDLVWSDPEDVDTWAISPRGAGWLFGAKVTNEFVHINNLKLICRAHQLVHEGYKFMFDEKLVTVWSAPNYCYRCGNIASIMVFKDVNTREPKLFRAVPDSERVIPPRTTTPYFL

SEQ ID NO: 60009 - protein, 125 aa, Homo sapiens
MFLLPRLQLLGQMRLCDYVCDLLLEESNVQPVSTPVTVCGDIHGQFYDLCELFRTGGQVPDTNYIFMGDFVDRGYYSLETFTYLLALKAKWPDRITLLRGNHESRQITQVYGFYDECQTKYGNAN

SEQ ID NO: 60010 - protein, 386 aa, Homo sapiens
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMETKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 60011 - protein, 199 aa, Homo sapiens
MDALNSMQNFLRGRPKTFKSLENAIEWSVKSGQIRNLESARVSMVGQVKQCEGITSPEGSKSIVEGIIEEEEEDEEGSESISKRKKEDDMETKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 60012 - protein, 400 aa, Homo sapiens
MSALEKSMHLGRLPSRPPLPGSGGSQSGAKMRMGPGRKRDFSPVPWSQYFESMEDVEVENETGKDTFRVYKSGSEGPVLLLLHGGGHSALSWAVFTAAIISRVQCRIVALDLRSHGETKVKNPEDLSAETMAKDVGNVVEAMYGDLPPPIMLIGHSMGGAIAVHTASSNLVPSLLGLCMIDVVEGTAMDALNSMQNFLRGRPKTFKSLENAIEWSVKSGQIRNLESARVSMVGQVKQCEGITSPEGSKSIVEGIIEEEEEDEEGSESISKRKKEDDMEGLPSETQNLLLFLQTKKDHPYTWRIELAKTEKYWDGWFRGLSNLFLSCPIPKLLLLAGVDRLDKDLTIGQMQGKFQMQVLPQCGHAVHEDAPDKVAEAVATFLIRHRFAEPIGGFQCVFPGC

SEQ ID NO: 60013 - protein, 591 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 60014 - protein, 600 aa, Homo sapiens
MGCSSSSTKTRRSDTSLRAALIIQNWYRGYKARLKARQHYALTIFQSIEYADEQGQMQLSTFFSFMLENYTHIHKEELEILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 60015 - protein, 653 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 60016 - protein, 376 aa, Homo sapiens
MGCSSSSTKTRRSDTSLRAALIIQNWYRGYKARLKARQHYALTIFQSIEYADEQGQMQLSTFFSFMLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQSGYYGKQRHQDIKRESDFTKK

SEQ ID NO: 60017 - protein, 588 aa, Homo sapiens
MLENYTHIHKEELELRNQSLESEQDMRDRWDYVDSIDVPDSYNGPRLQFPLTCTDIDLLLEAFKEQQILHAHYVLEVLFETKKVLKQMPNFTHIQTSPSKEVTICGDLHGKLDDLFLIFYKNGLPSERNPYVFNGDFVDRGKNSIEILMILCVSFLVYPNDLHLNRGNHEDFMMNLRYGFTKEILHKYKLHGKRILQILEEFYAWLPIGTIVDNEILVIHGGISETTDLNLLHRVERNKMKSVLIPPTETNRDHDTDSKHNKVGVTFNAHGRIKTNGSPTEHLTEHEWEQIIDILWSDPRGKNGCFPNTCRGGGCYFGPDVTSKILNKYQLKMLIRSHECKPEGYEICHDGKVVTIFSASNYYEEGSNRGAYIKLCSGTTPRFFQYQVTKATCFQPLRQRVDTMENSAIKILRERVISRKSDLTRAFQLQDHRKSGKLSVSQWAFCMENILGLNLPWRSLSSNLVNIDQNGNVEYMSSFQNIRIEKPVQEAHSTLVETLYRYRSDLEIIFNAIDTDHSGLISVEEFRAMWKLFSSHYNVHIDDSQVNKLANIMDLNKDGSIDFNEFLKAFYVVHRYEDLMKPDVTNLG

SEQ ID NO: 60018 - protein, 753 aa, Homo sapiens
MGSGTSTQHHFAFQNAERAFKAAALIQRWYRRYVARLEMRRRCTWSIFQSIEYAGQQDQVKLHDFFSYLMDHFIPSSHNDRDFLTRIFTEDRFAQDSEMKKCSDYESIEVPDSYTGPRLSFPLLPDHATALVEAFRLKQQLHARYVLNLLYETKKHLVQLPNINRVSTCYSEEITVCGDLHGQLDDLIFIFYKNGLPSPERSYVFNGDFVDRGKDSVEILMILFAFMLVYPKEFHLNRGNHEDHMVNLRYGFTKEVMNKYKVHGKEILRTLQDVFCWLPLATLIDEKVLILHGGVSDITDLELLDKIERSKIVSTMRCKTRQKSEKQMEEKRRANQKSSAQGPIPWFLPESRSLPSSPLRLGSYKAQKTSRSSSIPCSGSLDGRELSRQVRSSVELELERCRQQAGLLVTGEKEEPSRSASEADSEAGELRKPTQEEWRQVVDILWSDPMAQEGCKANTIRGGGCYFGPDVTQQLLQKYNMQFLIRSHECKPEGYEFCHNRKVLTIFSASNYYEVGSNRGAYVKLGPALTPHIVQYQANKVTHTLTMRQRISRVEESALRALREKLFAHSSDLLSEFKKHDADKVGLITLSDWAAAVESVLHLGLPWRMLRPQLVNSSADNMLEYKSWLKNLAKEQLSRENIQSSLLETLYRNRSNLETIFRIIDSDHSGFISLDEFRQTWKLFSSHMNIDITDDCICDLARSIDFNKDGHIDINEFLEAFRLVEKSCPEGDASECPQATNAKDSGCSSPGAH

SEQ ID NO: 60019 - protein, 598 aa, Homo sapiens
MGSGTSTQHHFAFQNAERAFKAAALIQRWYRRYVARLEMRRRCTWSIFQSIEYAGQQDQVKLHDFFSYLMDHFIPSSHNDRDFLTRIFTEDRFAQDSEMKKCSDYESIEVPDSYTGPRLSFPLLPDHATALVEAFRLKQQLHARYVLNLLYETKKHLVQLPNINRVSTCYSEEITVCGDLHGQLDDLIFIFYKNGLPSPERSYVFNGDFVDRGKDSVEILMILFAFMLVYPKEFHLNRGNHEDHMVNLRYGFTKEVMNKYKVHGKEILRTLQDVFCWLPLATLIDEKVLILHGGVSDITDLELLDKIERSKIVSTMRCKTRQKSEKQMEEKRRANQKSSAQGPIPWFLPESRSLPSSPLRLGSYKAQKTSRSSSIPCSGSLDGRELSRQVRSSVELELERCRQQAGLLVTGEKEEPSRSASEADSEAGELRKPTQEEWRQVVDILWSDPMAQEGCKANTIRGGGCYFGPDVTQQLLQKYNMQFLIRSHECKPEGYEFCHNRKVLTIFSASNYYEVGSNRGAYVKLGPALTPHIVQYQANKVTHTLTMRQRISRVEESALRALREKLFAHSSDLLSEFKKHDADKVGLASSQLCYYQQK

SEQ ID NO: 60020 - protein, 479 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 60021 - protein, 192 aa, Homo sapiens
MSIVLVCFSNAPKVSDEAVKKDSELDKHLESRVEEIMEKSGEEGMPDLAHVMRILSAENIPNLPPGGGLAGKRNVIEAVYSRLNPHRESDGASDEAEESGSQGKLVEALRQMRINHRGNYRQLLEEMLTSYRLAKVEGEESPAEPAATATSSNSDAGNPVTMQESHTESESGLAELDSSNEDAGTKMSGEKI

SEQ ID NO: 60022 - protein, 387 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGGAGDLEDPW

SEQ ID NO: 60023 - protein, 380 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDGQK

SEQ ID NO: 60024 - protein, 327 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEGKTNAF

SEQ ID NO: 60025 - protein, 378 aa, Homo sapiens
MGAFLDKPKTEKHNAHGAGNGLRYGLSSMQGWRVEMEDAHTAVVGIPHGLEDWSFFAVYDGHAGSRVANYCSTHLLEHITTNEDFRAAGKSGSALELSVENVKNGIRTGFLKIDEYMRNFSDLRNGMDRSGSTAVGVMISPKHIYFINCGDSRAVLYRNGQVCFSTQDHKPCNPREKERIQNAGGSVMIQRVNGSLAVSRALGDYDYKCVDGKGPTEQLVSPEPEVYEILRAEEDEFIILACDGIWDVMSNEELCEYVKSRLEVSDDLENVCNWVVDTCLHKGSRDNMSIVLVCFSNAPKVSDEAVKKDSELDKHLESRVEEIMEKSGEEGMPDLAHVMRILSAENIPNLPPGGGLAGKRNVIEAVYSRLNPHRESDG

SEQ ID NO: 60026 - protein, 505 aa, Homo sapiens
MLNRVRSAVAHLVSSGGAPPPRPKSPDLPNAASAPPAAAPEAPRSPPAKAGSGSATPAKAVEARASFSRPTFLQLSPGGLRRADDHAGRAVQSPPDTGRRLPWSTGYAEVINAGKSRHNEDQACCEVVYVEGRRSVTGVPREPSRGQGLCFYYWGLFDGHAGGGAAEMASRLLHRHIREQLKDLVEILQDPSPPPLCLPTTPGTPDSSDPSHLLGPQSCWSSQKEVSHESLVVGAVENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 60027 - protein, 299 aa, Homo sapiens
MASRLLHRHIREQLKDLKEVSHESLVVGAVENAFQLMDEQMARERRGHQVEGGCCALVVIYLLGKVYVANAGDSRAIIVRNGEIIPMSREFTPETERQRLQLLGFLKPELLGSEFTHLEFPRRVLPKELGQRMLYRDQNMTGWAYKKIELEDLRFPLVCGEGKKARVMATIGVTRGLGDHSLKVCSSTLPIKPFLSCFPEVRVYDLTQYEHCPDDVLVLGTDGLWDVTTDCEVAATVDRVLSAYEPNDHSRYTALAQALVLGARGTPRDRGWRLPNNKLGSGDDISVFVIPLGGPGSYS

SEQ ID NO: 60028 - protein, 372 aa, Homo sapiens
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADATLLTSGTTATVALLRDGIELVVASVGDSRAILCRKGKPMKLTIDHTPERKDEKERIKKCGGFVAWNSLGQPHVNGRLAMTRSIGDLDLKTSGVIAEPETKRIKLHHADDSFLVLTTDGINFMVNSQEICDFVNQCHDPNEAAHAVTEQAIQYGTEDNSTAVVVPFGAWGKYKNSEINFSFSRSFASSGRWA

SEQ ID NO: 60029 - protein, 233 aa, Homo sapiens
MSTAALITLVRSGGNQVRRRVLLSSRLLQDDRRVTPTCHSSTSEPRCSRFDPDGSGSPATWDNFGIWDNRIDEPILLPPSIKYGKPIPKISLENVGCASQIGKRKENEDRFDFAQLTDEVLYFAVYDGHGGPAAADFCHTHMEKCIMDLLPKEKNLETLLTLAFLEIDKAFSSHARLSADENCAWSAALDLEPVDTICGASVEREICLILSQVKESSGSYPGLREGSHISLSH

SEQ ID NO: 60030 - protein, 233 aa, Homo sapiens; identical to SEQ ID NO: 60029

SEQ ID NO: 60031 - protein, 194 aa, Homo sapiens
MIEDTMTLLSLLGRIMRYFLLRPETLFLLCISLALWSYFFHTDEVKTIVKSSRDAVKMVKGKVAEIMQNDRLGGLDVLEAEFSKTWEFKNHNVAVYSIQGRRDHMEDRFEVLTDLANKTHPSIFGIFDGHGGETAAEYVKSRLPEALKQHLQDYEKDKENSVLSYQTILEQQILSIDREMLEKLTVSYDEAVTF

SEQ ID NO: 60032 - protein, 360 aa, Homo sapiens
MIEDTMTLLSLLGRIMRYFLLRPETLFLLCISLALWSYFFHTDEVKTIVKSSRDAVKMVKGKVAEIMQNDRLGGLDVLEAEFSKTWEFKNHNVAVYSIQGRRDHMEDRFEVLTDLANKTHPSIFGIFDGHGGETAAEYVKSRLPEALKQHLQDYEKDKENSVLSYQTILEQQILSIDREMLEKLTVSYDEAGTTCLIALLSDKDLTVANVGDSRGVLCDKDGNAIPLSHDHKPYQLKERKRIKRAGGFISFNGSWRVQGILAMSRSLGDYPLKNLNVVIPDPDILTFDLDKLQPEFMILASDGLWDAFSNEEAVRFIKERLDEPHFGAKSIVLQSFYRGCPDNITVMVVKFRNSSKTEEQ

SEQ ID NO: 60033 - protein, 270 aa, Homo sapiens
MHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRYCSCWGPAWAWVGASSKPK

SEQ ID NO: 60034 - protein, 298 aa, Homo sapiens
MHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 60035 - protein, 247 aa, Homo sapiens
MGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 60036 - protein, 459 aa, Homo sapiens
MSAGWFRRRFLPGEPLPAPRPPGPHASPVPYRRPRFLRGSSSSPGAADASRRPDSRPVRSPARGRTLPWNAGYAEIINAEKSEFNEDQAACGKLCIRRCEFGAEEEWLTLCPEEFLTGHYWALFDGHGGPAAAILAANTLHSCLRRQLEAVVEGLVATQPPMHLNGRCICPSDPQFVEEKGIRAEDLVIGALESAFQECDEVIGRELEASGQMGGCTALVAVSLQGKLYMANAGDSRAILVRRDEIRPLSFEFTPETERQRIQQLAFVYPELLAGEFTRLEFPRRLKGDDLGQKVLFRDHHMSGWSYKRVEKSDLKYPLIHGQGRQARLLGTLAVSRGLGDHQLRVLDTNIQLKPFLLSVPQVTVLDVDQLELQEDDVVVMATDGLWDVLSNEQVAWLVRSFLPGNQEDPHRFSKLAQMLIHSTQGKEDSLTEEGQVSYDDVSVFVIPLHSQGQESSDH

SEQ ID NO: 60037 - protein, 606 aa, Homo sapiens
MRRSEVLAEESIVCLQKALNHLREIWELIGIPEDQRLQRTEVVKKHIKELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEALDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFARELSKASKSDATSGILNSTNIQS

SEQ ID NO: 60038 - protein, 566 aa, Homo sapiens
MRRSEVLAEESIVCLQKALNHLREIWELIGIPEDQRLQRTEVVKKHIKELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEALDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSARTFKGFQI

SEQ ID NO: 60039 - protein, 620 aa, Homo sapiens
MRRSEVLAEESIVCLQKALNHLREIWELIGIPEDQRLQRTEVVKKHIKELLDMMIAEEESLKERLIKSISVCQKELNTLCSELHVEPFQEEGETTILQLEKDLRTQVELMRKQKKERKQELKLLQEQDQELCEILCMPHYDIDSASVPSLEELNQFRQHVTTLRETKASRREEFVSIKRQIILCMEALDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSGGYPGSAPLQRNFSINSVASTYSEFAKDPSLSDSSTVGLQRELSKASKSDATSGILNSTNIQS

SEQ ID NO: 60040 - protein, 525 aa, Homo sapiens
MRRSEVLAEESIVCLQKALNHLREIWELIGIPEDQRLQRTEVVKKHIKEEGETTILQLEKDLRTQVELMRKQKKERKQELKLLQEQDQELCEILCMPHYDIDSASVPSLEELNQFRQHVTTLRETKASRREEFVSIKRQIILCMEALDHTPDTSFERDVVCEDEDAFCLSLENIATLQKLLRQLEMQKSQNEAVCEGLRTQIRELWDRLQIPEEEREAVATIMSGSKAKVRKALQLEVDRLEELKMQNMKKVIEAIRVELVQYWDQCFYSQEQRQAFAPFCAEDYTESLLQLHDAEIVRLKNYYEVHKELFEGVQKWEETWRLFLEFERKASDPNRFTNRGGNLLKEEKQRAKLQKMLPKLEEELKARIELWEQEHSKAFMVNGQKFMEYVAEQWEMHRLEKERAKQERQLKNKKQTETEMLYGSAPRTPSKRRGLAPNTPGKARKLNTTTMSNATANSSIRPIFGGTVYHSPVSRLPPSGSKPVAASTCSGKKTPRTGRHGANKENLELNGSILSARTFKGFQI

SEQ ID NO: 60041 - protein, 231 aa, Homo sapiens
MRVLGGRCGALLACLLLVLPVSEANFCLYFRNDFIYNRACISVLVGLSGCNFFYSICFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDC

SEQ ID NO: 60042 - protein, 676 aa, Homo sapiens
MRVLGGRCGALLACLLLVLPVSEANFLSKQQASQVLVRKRRANSLLEETKQGNLERECIEELCNKEEAREVFENDPETDYFYPKYLVCLRSFQTGLFTAARQSTNAYPDLRSCVNAIPDQCSPLPCNEDGYMSCKDGKASFTCTCKPGWQGEKCEFDINECKDPSNINGGCSQICDNTPGSYHCSCKNGFVMLSNKKDCKDVDECSLKPSICGTAVCKNIPGDFECECPEGYRYNLKSKSCEDIDECSENMCAQLCVNYPGGYTCYCDGKKGFKLAQDQKSCEVVSVCLPLNLDTKYELLYLAEQFAGVVLYLKFRLPEISRFSAEFDFRTYDSEGVILYAESIDHSAWLLIALRGGKIEVQLKNEHTSKITTGGDVINNGLWNMVSVEELEHSISIKIAKEAVMDINKPGPLFKPENGLLETKVYFAGFPRKVESELIKPINPRLDGCIRSWNLMKQGASGIKEIIQEKQNKHCLVTVEKGSYYPGSGIAQFHIDYNNVSSAEGWHVNVTLNIRPSTGTGVMLALVSGNNTVPFAVSLVDSTSEKSQDILLSVENTVIYRIQALSLCSDQQSHLEFRVNRNNLELSTPLKIETISHEDLQRQLAVLDKAMKAKVATYLGGLPDVPFSATPVNAFYNGCMEVNINGVQLDLDEAISKHNDIRAHSCPSVWKKTKNS

SEQ ID NO: 60043 - protein, 424 aa, Homo sapiens
MGCGTSKVLPEPPKDVQLDLVKKVEPFSGTKSDVYKHFITEVDSVGPVKAGFPAASQYAHPCPGPPTAGHTEPPSEPPRRARVAKYRAKFDPRVTAKYDIKALIGRGSFSRVVRVEHRATRQPYAIKMIETKYREGREVCESELRVLRRVRHANIIQLVEVFETQERVYMVMELATGGELFDRIIAKGSFTERDATRVLQMVLDGVRYLHALGITHRDLKPENLLYYHPGTDSKIIITDFGLASARKKGDDCLMKTTCGTPEYIAPEVLVRKPYTNSVDMWALGVIAYILLSGTMPFEDDNRTRLYRQILRGKYSYSGEPWPSVSNLAKDFIDRLLTVDPGARMTALQALRHPWVVSMAASSSMKNLHRSISQNLLKRASSRCQSTKSAQSTRSSRSTRSNKSRRVRERELRELNLRYQQQYNG

SEQ ID NO: 60044 - protein, 650 aa, Homo sapiens
MACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 60045 - protein, 353 aa, Homo sapiens
MSRSLDSARSFLERLEARGGREGAVLAGEFSKRCERYWAQEQEPLQTGLFCITLIKEKWLNEDIMLRTLKVTFQKESRSVYQLQYMSWPDRGVPSSPDHMLAMVEEARRLQGSGPEPLCVHCSAGCGRTGVLCTVDYVRQLLLTQMIPPDFSLFDVVLKMRKQRPAAVQTEEQYRFLYHTVAQMFCSTLQNASPHYQNIKENCAPLYDDALFLRTPQALLAIPRPPGGVLRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRV

SEQ ID NO: 60046 - protein, 410 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINYIENLWITLYLKLLMLDVKRSLKSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 60047 - protein, 752 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGSQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 60048 - protein, 1907 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 60049 - protein, 1505 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGALQIEQSEESDQGKYECVATNSAGTRYSAPANLYVRVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGSDDSGYPGNLHSSSMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60050 - protein, 1465 aa, Homo sapiens
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDPFVPTAILVPINDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 60051 - protein, 1440 aa, Homo sapiens
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDIRINREGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISREGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 60052 - protein, 1448 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFEEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 60053 - protein, 167 aa, Homo sapiens
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 60054 - protein, 82 aa, Homo sapiens
MNRPAPVEISYENMRFLITHNPTNATLNKFTEELKKYGVTTLVRVCDATYDKAPVEKEGIHVLKKKGSVQFQTAALFGEIPT

SEQ ID NO: 60055 - protein, 136 aa, Homo sapiens
MNRPAPVEISYENMRFLITHNPTNATLNKFTEDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 60056 - protein, 63 aa, Homo sapiens
MNRPAPVEISYENMRFLITHNPTNATLNKFTEELKKYGVTTLVRVCDATYDKAPVEKEGIHVL

SEQ ID NO: 60057 - protein, 22 aa, Homo sapiens
MNRPAPVEISYENMRFLITHNP

SEQ ID NO: 60058 - protein, 173 aa, Homo sapiens
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRAPVLVALALIESGMKYEDAIQFIRQKRRGAINSKQLTYLEKYRPKQRLRFKDPHTHKTRCCVM

SEQ ID NO: 60059 - protein, 148 aa, Homo sapiens
MARMNRPAPVEVSYKHMRFLITHNPTNATLSTFIEDLKKYGATTVVRVCEVTYDKTPLEKDGITVVDWPFDDGAPPPGKVVEDWLSLVKAKFCEAPGSCVAVHCVAGLGRKRRGAINSKQLTYLEKYRPKQRLRFKDPHTHKTRCCVM

SEQ ID NO: 60060 - protein, 148 aa, Homo sapiens; identical to SEQ ID NO: 60059

SEQ ID NO: 60061 - protein, 173 aa, Homo sapiens; identical to SEQ ID NO: 60058

SEQ ID NO: 60062 - protein, 70 aa, Homo sapiens
MARMNRPAPVEVSYKHMRFLITHNPTNATLSTFIEDLKKYGATTVVRVCEVTYDKTPLEKDGITVVDWPF

SEQ ID NO: 60063 - protein, 780 aa, Homo sapiens
MEQVEILRKFIQRVQAMKSPDHNGEDNFARDFMRLRRLSTKYRTEKIYPTATGEKEENVKKNRYKDILPFDHSRVKLTLKTPSQDSDYINANFIKGVYGPKAYVATQGPLANTVIDFWRMIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 60064 - protein, 661 aa, Homo sapiens
MIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNIAGTTHSGAEKDVDVSEDSPPPLPERTPESFVLASEHNTPVRSEWSELQSQERSEQKKSEGLITSENEKCDHPAGGIHYEMCIECPPTFSDKREQISENPTEATDIGFGNRCGKPKGPRDPPSEWT

SEQ ID NO: 60065 - protein, 543 aa, Homo sapiens
MIWEYNVVIIVMACREFEMGRKKCERYWPLYGEDPITFAPFKISCEDEQARTDYFIRTLLLEFQNESRRLYQFHYVNWPDHDVPSSFDSILDMISLMRKYQEHEDVPICIHCSAGCGRTGAICAIDYTWNLLKAGKIPEEFNVFNLIQEMRTQRHSAVQTKEQYELVHRAIAQLFEKQLQLYEIHGAQKIADGVNEINTENMVSSIEPEKQDSPPPKPPRTRSCLVEGDAKEEILQPPEPHPVPPILTPSPPSAFPTVTTVWQDNDRYHPKPVLHMVSSEQHSADLNRNYSKSTELPGKNESTIEQIDKKLERNLSFEIKKVPLQEGPKSFDGNTLLNRGHAIKIKSASPCIADKISKPQELSSDLNVGDTSQNSCVDCSVTQSNKVSVTPPEESQNSDTPPRPDRLPLDEKGHVTWSFHGPENAIPIPDLSEGNSSDINYQTRKTVSLTPSPTTQVETPDLVDHDNTSPLFRTPLSFTNPLHSDDSDSDERNSDGAVTQNKTNISTASATVSAATSTESISTRKVLPMSIARHNSRNNTFRC

SEQ ID NO: 60066 - protein, 2294 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 60067 - protein, 2434 aa, Homo sapiens
QFLFTKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 60068 - protein, 2485 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLGMTMHSSGNSSSQVPLKENDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 60069 - protein, 2466 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 60070 - protein, 2490 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLGMTMHSSGNSSSQVPLKENDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTVLFDKGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 60071 - protein, 139 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDV

SEQ ID NO: 60072 - protein, 2490 aa, Homo sapiens; identical to SEQ ID NO: 60070

SEQ ID NO: 60073 - protein, 1187 aa, Homo sapiens
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHSGILPAEAELMYINEVERLDGFGQEIFPVKDNHGNCVHLGIFFMGIFVRNRIGRQAVIYRWNDMGNITHNKSTILVELINKEETALFHTDDIENAKYISRLFATRHKFYKQNKICTEQSNSPPPIRRQPTWSRSSLPRQQPYILPPVHVQCGEHYSETHTSQDSIFHGNEEALYCNSHNSLDLNYLNGTVTNGSVCSVHSVNSLNCSQSFIQASPVSSNLSIPGSDIMRADYIPSHRHSAIIVPSYRPTPDYETVMRQMKRGILHTDSQSQSLRNLNIINTHAYNQPEDLVYSQPEMRERHPYTVPYGPQGVYSNKLVSPSDQRNPKNNVVPSKPGASAISHTVSTPELANMQLQGSHNYSTAHMLKNYLFRPPPPYPRPRPATSTPDLASHRHKYVSGSSPDLVTRKVQLSVKTFQEDSSPVVHQSLQEVSEPLTATKHHGTVNKRHSLEVMNSMVRGMEAMTLKSLHLPMARRNTLREQGPPEEGSGSHEVPQLPQYHHKKTFSDATMLIHSSESEEEEEEAPESVPQIPMLREKMEYSAQLQAALARIPNKPPPEYPGPRKSVSNGALRQDQASLPPAMARARVLRHGPAKAISMSRTDPPAVNGASLGPSISEPDLTSVKERVKKEPVKERPVSEMFSLEDSIIEREMMIRNLEKQKMAGLEAQKRPLMLAALNGLSVARVSGREENRVDATRVPMDERFRTLKKKLEEGMVFTEYEQIPKKKANGIFSTAALPENAERSRIREVVPYEENRVELIPTKENNTGYINASHIKVVVGGAEWHYIATQGPLPHTCHDFWQMVWEQGVNVIAMVTAEEEGGRTKSHRYWPKLGSKHSSATYGKFKVTTKFRTDSVCYATTGLKVKHLLSGQERTVWHLQYTDWPDHGCPEDVQGFLSYLEEIQSVRRHTNSMLEGTKNRHPPIVVHCSAGVGRTGVLILSELMIYCLEHNEKVEVPMMLRLLREQRMFMIQTIAQYKFVYQVLIQFLQNSRLI

SEQ ID NO: 60074 - protein, 211 aa, Homo sapiens
MPFGLKLRRTRRYNVLSKNCFVTRIRLLDSNVIECTLSVESTGQECLEAVAQRLELRETHYFGLWFLSKSQQARWVELEKPLKKHLDKFANEPLLFFGVMFYVPNVSWLQQEATRYQYYLQVKKDVLEGRLRCTLDQVIRLAGLAVQADFGDYNQFDSQDFLREYVLFPMDLALEEAVLEELTQKVAQEHKAHRTIMETVYTLAFSLWGFS

SEQ ID NO: 60075 - protein, 460 aa, Homo sapiens
MSRSLDSARSFLERLEARGGREGAVLAGEFSDIQACSAAWKADGVCSTVAGSRPENVRKNRYKDVLPYDQTRVILSLLQEEGHSDYINGNFIRGVDGSLAYIATQGPLPHTLLDFWRLVWEFGVKVILMACREIENGRKRCERYWAQEQEPLQTGLFCITLIKEKWLNEDIMLRTLKVTFQKESRSVYQLQYMSWPDRGVPSSPDHMLAMVEEARRLQGSGPEPLCVHCSAGCGRTGVLCTVDYVRQLLLTQMIPPDFSLFDVVLKMRKQRPAAVQTEEQYRFLYHTVAQMFCSTLQNASPHYQNIKENCAPLYDDALFLRTPQALLAIPRPPGGVLRSISVPGSPGHAMADTYAVVQKRGAPAGAGSGTQTGTGTGTGARSAEEAPLYSKVTPRAQRPGAHAEDARGTLPGRVPADQSPAGSGAYEDVAGGAQTGGLGFNLRIGRPKGPRDPPAEWTRV

SEQ ID NO: 60076 - protein, 415 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRWLYWQPILTKMGFMSVILVGAFVGWTLFFQQNAL

SEQ ID NO: 60077 - protein, 387 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRPRLTDT

SEQ ID NO: 60078 - protein, 392 aa, Homo sapiens
CQQEFRMYGKDGKGTNWMDQGDMECRMQEIDDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSESALRKRIREDRKATTAQKVQQMKQRLNENERKRKRWLYWQPILTKMGFMSVILVGAFVGWTLFFQQNAL

SEQ ID NO: 60079 - protein, 353 aa, Homo sapiens
MPTTIEREFEELDTQRRWQPLYLEIRNESHDYPHRVAKFPENRNRNRYRDVSPYDHSRVKLQNAENDYINASLVDIEEAQRSYILTQGPLPNTCCHFWLMVWQQKTKAVVMLNRIVEKESVKCAQYWPTDDQEMLFKETGFSVKLLSEDVKSYYTVHLLQLENINSGETRTISHFHYTTWPDFGVPESPASFLNFLFKVRESGSLNPDHGPAVIHCSAGIGRSGTFSLVDTCLVLMEKGDDINIKQVLLNMRKYRMGLIQTPDQLRFSYMAIIEGAKCIKGDSSIQKRWKELSKEDLSPAFDHSPNKIMTEKYNGNRIGLEEEKLTGDRCTGLSSKMQDTMEENSERPRLTDT

SEQ ID NO: 60080 - protein, 807 aa, Homo sapiens
MDQREILQKFLDEAQSKKITKEEFANEFLKLKRQSTKYKADKTYPTTVAEKPKNIKKNRYKDILPYDYSRVELSLITSDEDSSYINANFIKGVYGPKAYIATQGPLSTTLLDFWRMIWEYSVLIIVMACMEYEMGKKKCERYWAEPGEMQLEFGPFSVSCEAEKRKSDYIIRTLKVKFNSETRTIYQFHYKNWPDHDVPSSIDPILELIWDVRCYQEDDSVPICIHCSAGCGRTGVICAIDYTWMLLKDGIIPENFSVFSLIREMRTQRPSLVQTQEQYELVYNAVLELFKRQMDVIRDKHSGTESQAKHCIPEKNHTLQADSYSPNLPKSTTKAAKMMNQQRTKMEIKESSSFDFRTSEISAKEELVLHPAKSSTSFDFLELNYSFDKNADTTMKWQTKAFPIVGEPLQKHQSLDLGSLLFEGCSNSKPVNAAGRYFNSKVPITRTKSTPFELIQQRETKEVDSKENFSYLESQPHDSCFVEMQAQKVMHVSSAELNYSLPYDSKHQIRNASNVKHHDSSALGVYSYIPLVENPYFSSWPPSGTSSKMSLDLPEKQDGTVFPSSLLPTSSTSLFSYYNSHDSLSLNSPTNISSLLNQESAVLATAPRIDDEIPPPLPVWTPESFIVVEEAGEFSPNVPKSLSSAVKVKIGTSLEWGGTSEPKKFDDSVILRPSKSVKLRSPKSELHQDRSSPPPPLPERTLESFFLADEDCMQAQSIETYSTSYPDTMENSTSSKQTLKTPGKSFTRSKSLKILRNMKKSICNSCPPNKPAESVQSNNSSSFLNFGFANRFSKPKGPRNPPPTWNI

SEQ ID NO: 60081 - protein, 563 aa, Homo sapiens [sequence omitted]

SEQ ID NO: 60082 - protein, 1636 aa, Homo sapiens
MEAVPRMPMIWLDLKEAGDFHFQPAVKKFVLKNYGENPEAYNEELKKLELLRQNAVRVPRDFEGCSVLRKYLGQLHYLQSRVPMGSGQEAAVPVTWTEIFSGKSVAHEDIKYEQACILYNLGALHSMLGAMDKRVSEEGMKVSCTHFQCAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLDQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPAYTPELGLVPRSSPQHGVVSSPYVGVGPAPPVAGLPSAPPPQFSGPELAMAVRPATTTVDSIQAPIPSHTAPRPNPTPAPPPPCFPVPPPQPLPTPYTYPAGAKQPIPAQHHFSSGIPAGFPAPRIGPQPQPHPQPHPSQAFGPQPPQQPLPLQHPHLFPPQAPGLLPPQSPYPYAPQPGVLGQPPPPLHTQLYPGPAQDPLPAHSGALPFPSPGPPQPPHPPLAYGPAPSTRPMGPQAAPLTIRGPSSAGQSTPSPHLVPSPAPSPGPGPVPPRPPAAEPPPCLRRGAAAADLLSSSPESQHGGTQSPGGGQPLLQPTKVDAAEGRRPQALRLIERDPYEHPERLRQLQQELEAFRGQLGDVGALDTVWRELQDAQEHDARGRSIAIARCYSLKNRHQDVMPYDSNRVVLRSGKDDYINASCVEGLSPYCPPLVATQAPLPGTAADFWLMVHEQKVSVIVMLVSEAEMEKQKVARYFPTERGQPMVHGALSLALSSVRSTETHVERVLSLQFRDQSLKRSLVHLHFPTWPELGLPDSPSNLLRFIQEVHAHYLHQRPLHTPIIVHCSSGVGRTGAFALLYAAVQEVEAGNGIPELPQLVRRMRQQRKHMLQEKLHLRFCYEAVVRHVEQVLQRHGVPPPCKPLASASISQKNHLPQDSQDLVLGGDVPISSIQATIAKLSIRPPGGLESPVASLPGPAEPPGLPPASLPESTPIPSSSPPPLSSPLPEAPQPKEEPPVPEAPSSGPPSSSLELLASLTPEAFSLDSSLRGKQRMSKHNFLQAHNGQGLRATRPSDDPLSLLDPLWTLNKT

SEQ ID NO: 60083 - protein, 912 aa, Homo sapiens
MEAVPRMPMIWLDLKEAGDFHFQPAVKKNAVRVPRDFEGCSVLRKYLGQLHYLQSRVPMGSGQEAAVPVTWTEIFSGKSVAHEDIKYEQACILYNLGALHSMLGAMDKRVSEECAAGAFAYLREHFPQAYSVDMSRQILTLNVNLMLGQAQECLLEKSMLDNRKSFLVARISAQVVDYYKEACRALENPDTASLLGRIQKDWKKLVQMKIYYFAAVAHLHMGKQAEEQQKFGERVAYFQSALDKLNEAIKLAKGQPDTVQDALRFTMDVIGGKYNSAKKDNDFIYHEAVPALDTLQPVKGAPLVKPLPVNPTDPAVTGPDIFAKLVPMAAHEASSLYSEEKAKLLREMMAKIEDKNEVLDQFMDSMQLDPETVDNLDAYSHIPPQLMEKCAALSVRPDTVRNLVQSMQVLSGVFTDVEASLKDIRDLLEEDELLEQKFQEAVGQAGAISITSKAELAEVRREWAKYMEVHEKASFTNSELHRAMNLHVGNLRLLSGPLDQVRAALPTPALSPEDKAVLQNLKRILAKVQEMRDQRVSLEQQLRELIQKDDITASLVTTDHSEMKKLFEEQLKKYDQLKVYLEQNLAAQDRVLCALTEANVQYAAVRRVLSDLDQKWNSTLQTLVASYEAYEDLMKKSQEGRDFYADLESKVAALLERTQSTCQAREAARQQLLDRELKKKPPPRPTAPKPLLPRREESEAVEAGDPPEELRSLPPDMVAGPRLPDTFLGSATPLHFPPSPFPSSTGPGPHYLSGPLPPGTYSGPTQLIQPRAPGPHAMPVAPGPALYPAPSSAPSFTSVWASAPTAAPSTPASTSLPTPGPRTPTPTIPLPLCPSAWGPGAAATPPTHPALPRSRSRPSASPLRGSAFPQPWAPSASPSPTGIWSCPFYQTHGPPGSPSYHSRALVCWPVHP

SEQ ID NO: 60084 - protein, 565 aa, Homo sapiens
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLACGVLWFSGYGHIWSQNATNLVSSLLTLLKQLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 60085 - protein, 533 aa, Homo sapiens
MNYEGARSERENHAADDSEGGALDMCCSERLPGLPQPIVMEALDEAEGLQDSQREMPPPPPPSPPSDPAQKPPPRGAGSHSLTVRSSLCLFAASQFLLEPTAWLDSGTWGVPSLLLVFLSVGLVLVTTLVWHLLRTPPEPPTPLPPEDRRQSVSRQPSFTYSEWMEEKIEDDFLDLDPVPETPVFDCVMDIKPEADPTSLTVKSMGLQERRGSNVSLTLDMCTPGCNEEGFGYLMSPREESAREYLLSASRVLQAEELHEKALDPFLLQAEFFEIPMNFVDPKEYDIPGLVRKNRYKTILPNPHSRVCLTSPDPDDPLSSYINANYIRGYGGEEKVYIATQGPIVSTVADFWRMVWQEHTPIIVMITNIEEMNEKCTEYWPEEQVAYDGVEITVQKVIHTEDYRLRLISLKSGTEERGLKHYWFTSWPDQKTPDRAPPLLHLVREVEEAAQQEGPHCAPIIVHCSAGIGRTGCFIATSICCQQLRQEGVVDILKTTCQLRQDRGGMIQTCEQYQFVHHVMSLYEKQLSHQSPE

SEQ ID NO: 60086 - protein, 565 aa, Homo sapiens; identical to SEQ ID NO: 60084

SEQ ID NO: 60087 - protein, 595 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 60088 - protein, 597 aa, Homo sapiens
MLSRGWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 60089 - protein, 556 aa, Homo sapiens
MLSRGVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKHKEDVYENLHTKNKREEKVKKQRSADKEKSKGSLKRK

SEQ ID NO: 60090 - protein, 624 aa, Homo sapiens
MVRWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQKQEVKNLHQRLEGQRPENKGKNRYKNILPFDHSRVILQGRDSNIPGSDYINANYIKNQLLGPDENAKTYIASQGCLEATVNDFWQMAWQENSRVIVMTTREVEKGRNKCVPYWPEVGMQRAYGPYSVTNCGEHDTTEYKLRTLQVSPLDNGDLIREIWHYQYLSWPDHGVPSEPGGVLSFLDQINQRQESLPHAGPIIVHCSAGIGRTGTIIVIDMLMENISTKGLDCDIDIQKTIQMVRAQRSGMVQTEAQYKFIYVAIAQFIETTKKKLEVLQSQKGQESEYGNITYPPAMKNAHAKASRTSSKSLESSAGTVAASPVRRGGQRGLPVPGPPVLSPDLHQLPVLAPLHPAADTRRMCMRTCTLRTRGRRK

SEQ ID NO: 60091 - protein, 360 aa, Homo sapiens
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 60092 - protein, 465 aa, Homo sapiens
MVGKAWPLTHSQGTGPWAPEGHRREAADPWWQRQQAQEGRMQLGCAWVAARRGGGRKLASWSLLSPQRQTDRQTDSWQEAAWGPQLLQQTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 60093 - protein, 399 aa, Homo sapiens
MGASFWPIRQAREQQRRALSFRQTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 60094 - protein, 154 aa, Homo sapiens
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANY

SEQ ID NO: 60095 - protein, 441 aa, Homo sapiens
KRRRAASMNRLGCWPARSLPRSGRGSGQRSLGLGGHPSGPRHPGTPAAKRTWESPGVRARDCPLSTSWLSEPPLGPAPHLSMVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGRAQSQEDGDYINANYIRGYDGKEKVYIATQGPMPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 60096 - protein, 140 aa, Homo sapiens
MVQAHGGRSRAQPLTLSLGAAMTQPPPEKTPAKKHVRLQERRGSNVALMLDVRSLGAVEPICSVNTPREVTLHFLRTAGHPLTRWALQRQPPSPKQLEEEFLKIPSNFVSPEDLDIPGHASKDRYKTILPNPQSRVCLGR

SEQ ID NO: 60097 - protein, 360 aa, Homo sapiens; identical to SEQ ID NO: 60091

SEQ ID NO: 60098 - protein, 189 aa, Homo sapiens
MPNTVSDFWEMVWQEEVSLIVMLTQLREGKEKCVHYWPTEEETYGPFQIRIQDMKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 60099 - protein, 136 aa, Homo sapiens
MKECPEYTVRQLTIQYQEERRSVKHILFSAWPDHQTPESAGPLLRLVAEVEESPETAAHPGPIVVHCSAGIGRTGCFIATRIGCQQLKARGEVDILGIVCQLRLDRGGMIQTAEQYQFLHHTLALYAGQLPEEPSP

SEQ ID NO: 60100 - protein, 793 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 60101 - protein, 793 aa, Homo sapiens; identical to SEQ ID NO: 60100

SEQ ID NO: 60102 - protein, 793 aa, Homo sapiens; identical to SEQ ID NO: 60100

SEQ ID NO: 60103 - protein, 658 aa, Homo sapiens
MVALSSLLVIVFIIIVLYMLRRFRKAELMSRNTEKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 60104 - protein, 802 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 60105 - protein, 802 aa, Homo sapiens; identical to SEQ ID NO: 60104

SEQ ID NO: 60106 - protein, 200 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYMLRFKKYKQAGSHSNSFRLSNGRTEDV

SEQ ID NO: 60107 - protein, 813 aa, Homo sapiens
MDDAVQITKISMDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASKEENKEKNRYVNILPYDHSRVHLTPVEGVPDSDYINASFINGYQEKNKFIAAQGPKEETVNDFWRMIWEQNTATIVMVTNLKERKECKCAQYWPDQGCWTYGNIRVSVEDVTVLVDYTVRKFCIQQVGDMTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 60108 - protein, 175 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSGNSDSKDRRDETPIIAVMVALSSLLVIVFIIIVLYML

SEQ ID NO: 60109 - protein, 138 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPS

SEQ ID NO: 60110 - protein, 253 aa, Homo sapiens
MDSWFILVLLGSGLICVSANNATTVAPSVGITRLINSSTAEPVKEEAKTSNPTSSLTSLSVAPTFSPNITLGPTYLTTVNSSDSDNGTTRTASTNSIGITISPNGTWLPDNQFTDARTEPWEGNSSTAATTPETFPPSDETPIIAVMVALSSLLVIVFIIIVLYMLRFKKYKQAGSHSNSFRLSNGRTEDVEPQSVPLLARSPSTNRKYPPLPVDKLEEEINRRMADDNKLFREEFNALPACPIQATCEAASK

SEQ ID NO: 60111 - protein, 412 aa, Homo sapiens
MTNRKPQRLITQFHFTSWPDFGVPFTPIGMLKFLKKVKACNPQYAGAIVVHCSAGVGRTGTFVVIDAMLDMMHTERKVDVYGFVSRIRAQRCQMVQTDMQYVFIYQALLEHYLYGDTELEVTSLETHLQKIYNKIPGTSNNGLEEEFKKLTSIKIQNDKMRTGNLPANMKKNRVLQIIPYEFNRVIIPVKRGEENTDYVNASFIDGYRQKDSYIASQGPLLHTIEDFWRMIWEWKSCSIVMLTELEERGQEKCAQYWPSDGLVSYGDITVELKKEEECESYTVRDLLVTNTRENKSRQIRQFHFHGWPEVGIPSDGKGMISIIAAVQKQQQQSGNHPITVHCSAGAGRTGTFCALSTVLERVKAEGILDVFQTVKSLRLQRPHMVQTLEQYEFCYKVVQEYIDAFSDYANFK

SEQ ID NO: 60112 - protein, 1997 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 60113 - protein, 2215 aa, Homo sapiens
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 60114 - protein, 1907 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGNDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 60115 - protein, 919 aa, Homo sapiens
MEAEFYMVILTCLIFRNSEGFQIVHVQKQQCLFKNEKVVVGSCNRTIQNQQWMWTEDEKLLHVKSALCLAISNSSRGPSRSAILDRCSQAPRWTCYDQEGFLEVENASLFLQKQGSRVVVKKARKYLHSWMKIDVNKEGKLVNESLCLQKAGLGAEVSVRSTRNTAPPQILTTFNAVPDGLVFLIRNTTEAFIRNAAENYSQNSSERQHPNLHMTGITDTSWVLSTTQPFSSTTEETGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPDKVANLEANNNGRMRSLVVSWSPPAGDWEQYRILLFNDSVVLLNITVGKEETQYVMDDTGLVPGRQYEVEVIVESGNLKNSERCQGRTVPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPDKVQGVSVSNSARSDYLRVSWVHATGDFDHYEVTIKNKNNFIQTKAFPSQKTNVYLFS

SEQ ID NO: 60116 - protein, 1907 aa, Homo sapiens
MLSHGAGLALWITLSLLQTGLAEPERCNFTLAESKASSHSVSIQWRILGSPCNFSLIYSSDTLGAALCPTFRIDNTTYGCNLQDLQAGTIYNFRIISLDEERTVVLQTDPLPPARFGVSKEKTTSTSLHVWWTPSSGKVTSYEVQLFDENNQKIQGVQIQESTSWNEYTFFNLTAGSKYNIAITAVSGGKRSFSVYTNGSTVPSPVKDIGISTKANSLLISWSHGSGNVERYRLMLMDKGILVHGGVVDKHATSYAFHGLTPGYLYNLTVMTEAAGLQNYRWKLVRTAPMEVSNLKVTNDGSLTSLKVKWQRPPGNVDSYNITLSHKGTIKESRVLAPWITETHFKELVPGRLYQVTVSCVSGELSAQKMAVGRTFPLAVLQLRVKHANETSLSIMWQTPVAEWEKYIISLADRDLLLIHKSLSKDAKEFTFTDLVPGRKYMATVTSISGDLKNSSSVKGRTVPAQVTDLHVANQGMTSSLFTNWTQAQGDVEFYQVLLIHENVVIKNESISSETSRYSFHSLKSGSLYSVVVTTVSGGISSRQVVVEGRTVPSSVSGVTVNNSGRNDYLSVSWLLAPGDVDNYEVTLSHDGKVVQSLVIAKSVRECSFSSLTPGRLYTVTITTRSGKYENHSFSQERTVPDKVQGVSVSNSARSDYLRVSWVHATGDFDHYEVTIKNKNNFIQTKSIPKSENECVFVQLVPGRLYSVTVTTKSGQYEANEQGNGRTIPEPVKDLTLRNRSTEDLHVTWSGANGDVDQYEIQLLFNDMKVFPPFHLVNTATEYRFTSLTPGRQYKILVLTISGDVQQSAFIEGFTVPSAVKNIHISPNGATDSLTVNWTPGGGDVDSYTVSAFRHSQKVDSQTIPKHVFEHTFHRLEAGEQYQIMIASVSGSLKNQINVVGRTVPASVQGVIADNAYSSYSLIVSWQKAAGVAERYDILLLTENGILLRNTSEPATTKQHKFEDLTPGKKYKIQILTVSGGLFSKEAQTEGRTVPAAVTDLRITENSTRHLSFRWTASEGELSWYNIFLYNPDGNLQERAQVDPLVQSFSFQNLLQGRMYKMVIVTHSGELSNESFIFGRTVPASVSHLRGSNRNTTDSLWFNWSPASGDFDFYELILYNPNGTKKENWKDKDLTEWRFQGLVPGRKYVLWVVTHSGDLSNKVTAESRTAPSPPSLMSFADIANTSLAITWKGPPDWTDYNDFELQWLPRDALTVFNPYNNRKSEGRIVYGLRPGRSYQFNVKTVSGDSWKTYSKPIFGSVRTKPDKIQNLHCRPQNSTAIACSWIPPDSDFDGYSIECRKMDTQEVEFSRKLEKEKSLLNIMMLVPHKRYLVSIKVQSAGMTSEVVEDSTITMIDRPPPPPPHIRVNEKDVLISKSSINFTVNCSWFSDTNGAVKYFTVVVREADGSDELKPEQQHPLPSYLEYRHNASIRVYQTNYFASKCAENPNSNSKSFNIKLGAEMESLGGKCDPTQQKFCDGPLKPHTAYRISIRAFTQLFDEDLKEFTKPLYSDTFFSLPITTESEPLFGAIEGVSAGLFLIGMLVAVVALLICRQKVSHGRERPSARLSIRRDRPLSVHLNLGQKGNRKTSCPIKINQFEGHFMKLQADSNYLLSKEYEELKDVGRNQSCDIALLPENRGKNRYNNILPYDATRVKLSNVDDDPCSDYINASYIPGNNFRREYIVTQGPLPGTKDDFWKMVWEQNVHNIVMVTQCVEKGRVKCDHYWPADQDSLYYGDLILQMLSESVLPEWTIREFKICGEEQLDAHRLIRHFHYTVWPDHGVPETTQSLIQFVRTVRDYINRSPGAGPTVVHCSAGVGRTGTFIALDRILQQLDSKDSVDIYGAVHDLRLHRVHMVQTECQYVYLHQCVRDVLRARKLRSEQENPLFPIYENVNPEYHRDPVYSRH

SEQ ID NO: 60117 - protein, 206 aa, Homo sapiens
MALPCTLGLGMLLALPGALGSGGSAEDSVGSSSVTVVLLLLLLLLLATGLALAWRRLSRDSGGYYHPARLGAALWGRTRRLLWASPPGRWLQARAELGSTDNDLERQEDEQDTDYDHVADGGLQADPGEGEQQCGEASSPEQVPVRAEEARDSDTEGDLVLGSPGPASAGGSAEALLSDLHAFAGSAAWDDSARAAGGQGLHVTAL

SEQ ID NO: 60118 - protein, 1383 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSVSVCATYHTGALQIEQSEESDQGKYECVATNSAGTRYSAPANLYVRVNRKVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSSKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60119 - protein, 1506 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60120 - protein, 1912 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60121 - protein, 1890 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60122 - protein, 1899 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGALQIEQSEESDQGKYECVATNSAGTRYSAPANLYVRVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSKPSAPPQDISCTSPSSTSILVSWQPPPVEKQNGIITEYSIKYTAVDGEDDKPHEILGIPSDTTKYLLEQLEKWTEYRITVTAHTDVGPGPESLSVLIRTNEDVPSGPPRKVEVEAVNSTSVKVSWRSPVPNKQHGQIRGYQVHYVRMENGEPKGQPMLKDVMLADAQWEFDDTTEHDMIISGLQPETSYSLTVTAYTTKGDGARSKPKLVSTTGAVPGKPRLVINHTQMNTALIQWHPPVDTFGPLQGYRLKFGRKDMEPLTTLEFSEKEDHFTATDIHKGASYVFRLSARNKVGFGEEMVKEISIPEEVPTGFPQNLHSEGTTSTSVQLSWQPPVLAERNGIITKYTLLYRDINIPLLPMEQLIVPADTTMTLTGLKPDTTYDVKVRAHTSKGPGPYSPSVQFRTLPVDQVFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60123 - protein, 1912 aa, Homo sapiens; identical to SEQ ID NO: 60120

SEQ ID NO: 60124 - protein, 1502 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60125 - protein, 1505 aa, Homo sapiens [sequence omitted]

SEQ ID NO: 60126 - protein, 93 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDE

SEQ ID NO: 60127 - protein, 1505 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSESIGGTPIRGALQIEQSEESDQGKYECVATNSAGTRYSAPANLYVRELREVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKSKPDRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60128 - protein, 1502 aa, Homo sapiens
MVHVARLLLLLLTFFLRTDAETPPRFTRTPVDQTGVSGGVASFICQATGDPRPKIVWNKKGKKVSNQRFEVIEFDDGSGSVLRIQPLRTPRDEAIYECVASNNVGEISVSTRLTVLREDQIPRGFPTIDMGPQLKVVERTRTATMLCAASGNPDPEITWFKDFLPVDTSNNNGRIKQLRSGRVFHTGALQIEQSEESDQGKYECVATNSAGTRYSAPANLYVRVNRKVRRVPPRFSIPPTNHEIMPGGSVNITCVAVGSPMPYVKWMLGAEDLTPEDDMPIGRNVLELNDVRQSANYTCVAMSTLGVIEAIAQITVKALPKPPGTPVVTESTATSITLTWDSGNPEPVSYYIIQHKPKNSEELYKEIDGVATTRYSVAGLSPYSDYEFRVVAVNNIGRGPPSEPVLTQTSEQAPSSAPRDVQARMLSSTTILVQWKEPEEPNGQIQGYRVYYTMDPTQHVNNWMKHNVADSQITTIGNLVPQKTYSVKVLAFTSIGDGPLSSDIQVITQTGVPGQPLNFKAEPESETSILLSWTPPRSDTIANYELVYKDGEHGEEQRITIEPGTSYRLQGLKPNSLYYFRLAARSPQGLGASTAEISARTMQSMFAKNFHVKAVMKTSVLLSWEIPENYNSAMPFKILYDDGKMVEEVDGRATQKLIVNLKPEKSYSFVLTNRGNSAGGLQHRVTAKTAPDVLRTKPAFIGKTNLDGMITVQLPEVPANENIKGYYIIIVPLKKSRGKFIKPWESPDEMELDELLKEISRKRRSIRYGREVELKPYIAAHFDVLPTEFTLGDDKHYGGFTNKQLQSGQEYVFFVLAVMEHAESKMYATSPYSDPVVSMDLDPQPITDEEEGLIWVVGPVLAVVFIICIVIAILLYKRKPYRKRAESDSRKSSIPNNKEIPSHHPTDPVELRRLNFQTPGMASHPPIPILELADHIERLKANDNLKFSQEYESIDPGQQFTWEHSNLEVNKPKNRYANVIAYDHSRVLLSAIEGIPGSDYVNANYIDGYRKQNAYIATQGSLPETFGDFWRMIWEQRSATVVMMTKLEERSRVKCDQYWPSRGTETHGLVQVTLLDTVELATYCVRTFALYKNGSSEKREVRQFQFTAWPDHGVPEHPTPFLAFLRRVKTCNPPDAGPMVVHCSAGVGRTGCFIVIDAMLERIKHEKTVDIYGHVTLMRAQRNYMVQTEDQYIFIHDALLEAVTCGNTEVPARNLYAYIQKLTQIETGENVTGMELEFKRLASSKAHTSRFISANLPCNKFKNRLVNIMPYESTRVCLQPIRGVEGSDYINASFIDGYRQQKAYIATQGPLAETTEDFWRMLWEHNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDQYQFSYRAALEYLGSFDHYAT

SEQ ID NO: 60129 - protein, 1912 aa, Homo sapiens; identical to SEQ ID NO: 60120

SEQ ID NO: 60130 - protein, 700 aa, Homo sapiens
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 60131 - protein, 642 aa, Homo sapiens
MSNRSSFSRLTWFRKQRKAVVSTSDKKMPNGILEEQEQQRVMLLSRSPSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCSAGAGRTGTFIALSNILERVKAEGLLDVFQAVKSLRLQRPHMVQTLEQYEFCYKVVQDFIDIFSDYANFK

SEQ ID NO: 60132 - protein, 700 aa, Homo sapiens; identical to SEQ ID NO: 60130

SEQ ID NO: 60133 - protein, 145 aa, Homo sapiens
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNMTILG

SEQ ID NO: 60134 - protein, 669 aa, Homo sapiens
MVSQRLPRKTRGPPWSPCVHSCWWVLACRSPGLSGATRPLPTATRQPRPQALRTRAPPSRCWPGCYCRCCSSSSCSFSPPTSSGSGPKKYFPIPVEHLEEEIRIRSADDCKQFREEFNSLPSGHIQGTFELANKEENREKNRYPNILPNDHSRVILSQLDGIPCSDYINASYIDGYKEKNKFIAAQGPKQETVNDFWRMVWEQKSATIVMLTNLKERKEEKCHQYWPDQGCWTYGNIRVCVEDCVVLVDYTIRKFCIQPQLPDGCKAPRLVSQLHFTSWPDFGVPFTPIGMLKFLKKVKTLNPVHAGPIVVHCSAGVGRTGTFIVIDAMMAMMHAEQKVDVFEFVSRIRNQRPQMVQTDMQYTFIYQALLEYYLYGDTELDVSSLEKHLQTMHGTTTHFDKIGLEEEFRKLTNVRIMKENMRTGNLPANMKKARVIQIIPYDFNRVILSMKRGQEYTDYINASFIDGYRQKDYFIATQGPLAHTVEDFWRMIWEWKSHTIVMLTEVQEREQDKCYQYWPTEGSVTHGEITIEIKNDTLSEAISIRDFLVTLNQPQARQEEQVRVVRQFHFHGWPEIGIPAEGKGMIDLIAAVQKQQQQTGNHPITVHCRNSMNSATKWYKILLIYFLIMLISNEDSCLKIFFNLMEQRRSHFPQDARLSPPLSGTAFAL

SEQ ID NO: 60135 - protein, 140 aa, Homo sapiens
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFN

SEQ ID NO: 60136 - protein, 154 aa, Homo sapiens
MEPLCPLLLVGFSLPLARALRGNETTADSNETTTTSGPPDPGASQPLLAWLLLPLLLLLLVLLLAAYFFRFRKQRKAVVSTSDKKMPNGILEEQEQQRVMLLSRSPSGPKKYFPIPVEHLEEEIRIRSADDCKQFREEFNSLPSGHIQGTFELA

SEQ ID NO: 60137 - protein, 1907 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQWRPEESEDYETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 60138 - protein, 1898 aa, Homo sapiens
MAPEPAPGRTMVPLVPALVMLGLVAGAHGDSKPVFIKVPEDQTGLSGGVASFVCQATGEPKPRITWMKKGKKVSSQRFEVIEFDDGAGSVLRIQPLRVQRDEAIYECTATNSLGEINTSAKLSVLEEEQLPPGFPSIDMGPQLKVVEKARTATMLCAAGGNPDPEISWFKDFLPVDPATSNGRIKQLRSGALQIESSEESDQGKYECVATNSAGTRYSAPANLYVRVRRVAPRFSIPPSSQEVMPGGSVNLTCVAVGAPMPYVKWMMGAEELTKEDEMPVGRNVLELSNVVRSANYTCVAISSLGMIEATAQVTVKALPKPPIDLVVTETTATSVTLTWDSGNSEPVTYYGIQYRAAGTEGPFQEVDGVATTRYSIGGLSPFSEYAFRVLAVNSIGRGPPSEAVRARTGEQAPSSPPRRVQARMLSASTMLVQWEPPEEPNGLVRGYRVYYTPDSRRPPNAWHKHNTDAGLLTTVGSLLPGITYSLRVLAFTAVGDGPPSPTIQVKTQQGVPAQPADFQAEVESDTRIQLSWLLPPQERIIMYELVYWAAEDEDQQHKVTFDPTSSYTLEDLKPDTLYRFQLAARSDMGVGVFTPTIEARTAQSTPSAPPQKVMCVSMGSTTVRVSWVPPPADSRNGVITQYSVAYEAVDGEDRGRHVVDGISREHSSWDLVGLEKWTEYRVWVRAHTDVGPGPESSPVLVRTDEDVPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 60139 - protein, 1907 aa, Homo sapiens; identical to SEQ ID NO: 60137

SEQ ID NO: 60140 - protein, 1266 aa, Homo sapiens
MYELVYWAAEDEDQQHKVTFDPTSSYTLEDLKPDTLYRFQLAARSDMGVGVFTPTIEARTAQSMPSGPPRKVEVEPLNSTAVHVYWKLPVPSKQHGQIRGYQVTYVRLENGEPRGLPIIQDVMLAEAQETTISGLTPETTYSVTVAAYTTKGDGARSKPKIVTTTGAVPGRPTMMISTTAMNTALLQWHPPKELPGELLGYRLQYCRADEARPNTIDFGKDDQHFTVTGLHKGTTYIFRLAAKNRAGLGEEFEKEIRTPEDLPSGFPQNLHVTGLTTSTTELAWDPPVLAERNGRIISYTVVFRDINSQQELQNITTDTRFTLTGLKPDTTYDIKVRAWTSKGSGPLSPSIQSRTMPVEQVFAKNFRVAAAMKTSVLLSWEVPDSYKSAVPFKILYNGQSVEVDGHSMRKLIADLQPNTEYSFVLMNRGSSAGGLQHLVSIRTAPDLLPHKPLPASAYIEDGRFDLSMPHVQDPSLVRWFYIVVVPIDRVGGSMLTPRWSTPEELELDELLEAIEQGGEEQRRRRRQAERLKPYVAAQLDVLPETFTLGDKKNYRGFYNRPLSPDLSYQCFVLASLKEPMDQKRYASSPYSDEIVVQVTPAQQQEEPEMLWVTGPVLAVILIILIVIAILLFKRKRTHSPSSKDEQSIGLKDSLLAHSSDPVEMRRLNYQTPGSSVPSCPNTSSMRDHPPIPITDLADNIERLKANDGLKFSQEYESIDPGQQFTWENSNLEVNKPKNRYANVIAYDHSRVILTSIDGVPGSDYINANYIDGYRKQNAYIATQGPLPETMGDFWRMVWEQRTATVVMMTRLEEKSRVKCDQYWPARGTETCGLIQVTLLDTVELATYTVRTFALHKSGSSEKRELRQFQFMAWPDHGVPEYPTPILAFLRRVKACNPLDAGPMVVHCSAGVGRTGCFIVIDAMLERMKHEKTVDIYGHVTCMRSQRNYMVQTEDQYVFIHEALLEAATCGHTEVPARNLYAHIQKLGQVPPGESVTAMELEFKLLASSKAHTSRFISANLPCNKFKNRLVNIMPYELTRVCLQPIRGVEGSDYINASFLDGYRQQKAYIATQGPLAESTEDFWRMLWEHNSTIIVMLTKLREMGREKCHQYWPAERSARYQYFVVDPMAEYNMPQYILREFKVTDARDGQSRTIRQFQFTDWPEQGVPKTGEGFIDFIGQVHKTKEQFGQDGPITVHCSAGVGRTGVFITLSIVLERMRYEGVVDMFQTVKTLRTQRPAMVQTEDQYQLCYRAALEYLGSFDHYAT

SEQ ID NO: 60141 - protein, 1898 aa, Homo sapiens; identical to SEQ ID NO: 60138

SEQ ID NO: 60142 - protein, 1202 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 60143 - protein, 1185 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIELQEIISKQSREQSQMKERLASLSSHVTELEEDLDTARKDLIKSEEMNTKLQRDVREAMAQKEDMEERITTLEKRYLAAQREATSVHDLNDKLENEIANKDSMHRQTEDKNRQLQERLELAEQKLQQTLRKAETLPEVEAELAQRVAALSKAEERHGNIEERLRQMEAQLEEKNQELQRARQREKMNEEHNKRLSDTVDKLLSESNERLQLHLKERMAALEDKNSLLREVESAKKQLEETQHDKDQLVLNIEALRAELDHMRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGM

SEQ ID NO: 60144 - protein, 158 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEV

SEQ ID NO: 60145 - protein, 99 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNV

SEQ ID NO: 60146 - protein, 699 aa, Homo sapiens
MRLRGASLHHGRPHLGSVPDFRFPMADGHTDSYSTSAVLRRPQKGRLAALRDEPSKVQTLNEQDWERAQQASVLANVAQAFESDADVSDGEDDRDTLLSSVDLLSPSGQADAHTLAMMLQEQLDAINKEIRLIQEEKENTEQRAEEIESRVGSGSLDNLGRFRSMSSIPPYPASSLASSSPPGSGRSTPRRIPHSPAREVDRLGVMTLPSDLRKHRRKLPPSREEVRDDKTTIKCETSPPSSPRALRLDRLHKGALHTVSHEDIRDIRNSTGSQDGPVSNPSSSNSSQDSLHKAPKKKGIKSSIGRLFGKKEKGRPGQTGKEALGQAGVSETDNSSQDALGLSKLGGQAEKNRKLQKKHELLEEARRQGLPFAQWDGPTVVVWLELWVGMPAWYVAACRANVKSGAIMSALSDTEIQREIGISNPLHRLKLRLAIQEIMSLTSPSAPPTSRTTLAYGDMNHEWIGNEWLPSLGLPQYRSYFMECLVDARMLDHLTKKDLRGQLKMVDSFHRNSFQCGIMCLRRLNYDRKELERKREESQSEIKDVLVWSNDRVIRWILSIGLKEYANNLIESGVHGALLALDETFDFSALALLLQIPTQNTQARAVLEREFNNLLVMGTDRRFDEDDDKSFRRAPSWRKKFRPKDIRGLAAGSAETLPANFRVTSSMSSPSMQPKKMQMDGNVSGTQRLDSATVRTYSC

SEQ ID NO: 60147 - protein, 1194 aa, Homo sapiens
MMCEVMPTISEDGRRGSALGPDEAGGELERLMVTMLTERERLLETLREAQDGLATAQLRLRELGHEKDSLQRQLSIALPQEFAALTKELNLCREQLLEREEEIAELKAERNNTRLLLEHLECLVSRHERSLRMTVVKRQAQSPGGVSSEVEVLKALKSLFEHHKALDEKVRERLRMALERVAVLEEELELSNQETLNLREQLSRRRSGLEEPGKDGDGQTLANGLGPGGDSNRRTAELEEALERQRAEVCQLRERLAVLCRQMSQLEEELGTAHRELGKAEEANSKLQRDLKEALAQREDMEERITTLEKRYLSAQREATSLHDANDKLENELASKESLYRQSEEKSRQLAEWLDDAKQKLQQTLQKAETLPEIEAQLAQRVAALNKAEERHGNFEERLRQLEAQLEEKNQELQRARQREKMNDDHNKRLSETVDKLLSESNERLQLHLKERMGALEEKNSLSEEIANMKKLQDELLLNKEQLLAEMERMQMEIDQLRGRPPSSYSRSLPGSALELRYSQAPTLPSGAHLDPYVAGSGRAGKRGRWSGVKEEPSKDWERSAPAGSIPPPFPGELDGSDEEEAEGMFGAELLSPSGQADVQTLAIMLQEQLEAINKEIKLIQEEKETTEQRAEELESRVSSSGLDSLGRYRSSCSLPPSLTTSTLASPSPPSSGHSTPRLAPPSPAREGTDKANHVPKEEAGAPRGEGPAIPGDTPPPTPRSARLERMTQALALQAGSLEDGGPPRGSEGTPDSLHKAPKKKSIKSSIGRLFGKKEKGRMGPPGRDSSSLAGTPSDETLATDPLGLAKLTGPGDKDRRNKRKHELLEEACRQGLPFAAWDGPTVVSWLELWVGMPAWYVAACRANVKSGAIMANLSDTEIQREIGISNPLHRLKLRLAIQEMVSLTSPSAPASSRTSTGNVWMTHEEMESLTATTKPETKEISWEQILAYGDMNHEWVGNDWLPSLGLPQYRSYFMESLVDARMLDHLNKKELRGQLKMVDSFHRVSLHYGIMCLKRLNYDRKDLERRREESQTQIRDVMVWSNERVMGWVSGLGLKEFATNLTESGVHGALLALDETFDYSDLALLLQIPTQNAQARQLLEKEFSNLISLGTDRRLDEDSAKSFSRSPSWRKMFREKDLRGVTPDSAEMLPPNFRSAAAGALGSPGLPLRKLQPEGQTSGSSRADGVSVRTYSC

SEQ ID NO: 60148 - protein, 576 aa, Homo sapiens
MSGQEFAALTKELNLCREQLLEREEEIAELKAERNNTRLLLEHLECLVSRHERSLRMTVVKRQAQSPGGVSSEVEVLKALKSLFEHHKALDEKVRERLRMALERVAVLEEELELSNQETLNLREQLSRRRSGLEEPGKDGDGQTLANGLGPGGDSNRRTAELEEALERQRAEVCQLRERLAVLCRQMSQLEEELGTAHRELGKAEEANSKLQRDLKEALAQREDMEERITTLEKRYLSAQREATSLHDANDKLENELASKESLYRQSEEKSRQLAEWLDDAKQKLQQTLQKAETLPEIEAQLAQRVAALNKAEERHGNFEERLRQLEAQLEEKNQELQRARQREKMNDDHNKRLSETVDKLLSESNERLQLHLKERMGALEEKNSLSEEIANMKKLQDELLLNKEQLLAEMERMQMEIDQLRGRPPSSYSRSLPGSALELRYSQAPTLPSGAHLDPYVAGSGRAGKRGRWSGVKEEPSKDWERSAPAGSIPPPFPGELDGSDEEEAEGMFGAELLSPSGQADVQTLAIMLQEQLEAINKEIKIMSLRRKLELHEGRGRPSQETPHHPLPALPVLRE

SEQ ID NO: 60149 - protein, 1445 aa, Homo sapiens
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGSLTTPPCSEIVEWIVFRRPVPISYHQLEAFYSIFTTEQQDHVKSVEYLRNNFRPQQRLHDRVVSKSAVRDSWNHDMTDFLENPLGTEASKVCSSPPIHMKVQPLNQTALQVSWSQPETIYHPPIMNYMISYSWTKNEDEKEKTFTKDSDKDLKATISHVSPDSLYLFRVQAVCRNDMRSDFSQTMLFQANTTRIFQGTRIVKTGVPTASPASSADMAPISSGSSTWTSSGIPFSFVSMATGMGPSSSGSQATVASVVTSTLLAGLGFGGGGISSFPSTVWPTRLPTAASASKQAARPVLATTEALASPGPDGDSSPTKDGEGTEEGEKDEKSESEDGEREHEEDGEKDSEKKEKSGVTHAAEERNQTEPSPTPSSPNRTAEGGHQTIPGHEQDHTAVPTDQTGGRRDAGPGLDPDMVTSTQVPPTATEEQYAGSDPKRPEMPSKKPMSRGDRFSEDSRFITVNPAEKNTSGMISRPAPGRMEWIIPLIVVSALTFVCLILLIAVLVYWRGCNKIKSKGFPRRFREVPSSGERGEKGSRKCFQTAHFYVEDSSSPRVVPNESIPIIPIPDDMEAIPVKQFVKHIGELYSNNQHGFSEDFEEVQRCTADMNITAEHSNHPENKHKNRYINILAYDHSRVKLRPLPGKDSKHSDYINANYVDGYNKAKAYIATQGPLKSTFEDFWRMIWEQNTGIIVMITNLVEKGRRKCDQYWPTENSEEYGNIIVTLKSTKIHACYTVRRFSIRNTKVKKGQKGNPKGRQNERVVIQYHYTQWPDMGVPEYALPVLTFVRRSSAARMPETGPVLVHCSAGVGRTGTYIVIDSMLQQIKDKSTVNVLGFLKHIRTQRNYLVQTEEQYIFIHDALLEAILGKETEVSSNQLHSYVNSILIPGVGGKTRLEKQFKLVTQCNAKYVECFSAQKECNKEKNRNSSVVPSERARVGLAPLPGMKGTDYINASYIMGYYRSNEFIITQHPLPHTTKDFWRMIWDHNAQIIVMLPDNQSLAEDEFVYWPSREESMNCEAFTVTLISKDRLCLSNEEQIIIHDFILEATQDDYVLEVRHFQCPKWPNPDAPISSTFELINVIKEEALTRDGPTIVHDEYGAVSAGMLCALTTLSQQLENENAVDVFQVAKMINLMRPGVFTDIEQYQFIYKAMLSLVSTKENGNGPMTVDKNGAVLIADESDPAESMESLV

SEQ ID NO: 60150 - protein, 102 aa, Homo sapiens
MRRLLEPCWWILFLKITSSVLHYVVCFPALTEGYVGALHENRHGSAVQIRRRKASGDPYWAYSGKSSCSNGDHTGQLTSHSTHLKAHFESLLCLSSVCSNLS

SEQ ID NO: 60151 - protein, 937 aa, Homo sapiens
MAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADKYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 60152 - protein, 1115 aa, Homo sapiens
MAGAGGGLGVWGNLVLLGLCSWTGARAPAPNPGRNLTVETQTTSSISLSWEVPDGLDSQNSNYWVQCTGDGGTTETRNTTATNVTVDGLGPGSLYTCSVWVEKDGVNSSVGTVTTATAPNPVRNLRVEAQTNSSIALTWEVPDGPDPQNSTYGVEYTGDGGRAGTRSTAHTNITVDGLEPGCLYAFSMWVGKNGINSSRETRNATTAHNPVRNLRVEAQTTSSISLSWEVPDGTDPQNSTYCVQCTGDGGRTETRNTTDTRVTVDGLGPGSLYTCSVWVEKDGVNSSVEIVTSATAPNPVRNLTVEAQTNSSIALTWEVPDGPDPQNSTYGVEYTGDGGRAGTRSTAHTNITVDRLEPGCLYVFSVWVGKNGINSSRETRNATTAPNPVRNLHMETQTNSSIALCWEVPDGPYPQDYTYWVEYTGDGGGTETRNTTNTSVTAERLEPGTLYTFSVWAEKNGARGSRQNVSISTVPNAVTSLSKQDWTNSTIALRWTAPQGPGQSSYSYWVSWVREGMTDPRTQSTSGTDITLKELEAGSLYHLTVWAERNEVRGYNSTLTAATAPNEVTDLQNETQTKNSVMLWWKAPGDPHSQLYVYWVQWASKGHPRRGQDPQANWVNQTSRTNETWYKVEALEPGTLYNFTVWAERNDVASSTQSLCASTYPDTVTITSCVSTSAGYGVNLIWSCPQGGYEAFELEVGGQRGSQDRSSCGEAVSVLGLGPARSYPATITTIWDGMKVVSHSVVCHTESAGVIAGAFVGILLFLILVGLLIFFLKRRNKKKQQKPELRDLVFSSPGDIPAEDFADHVRKNERDSNCGFADKYQQLSLVGHSQSQMVASASENNAKNRYRNVLPYDWSRVPLKPIHEEPGSDYINASFMPGLWSPQEFIATQGPLPQTVGDFWRLVWEQQSHTLVMLTNCMEAGRVKCEHYWPLDSQPCTHGHLRVTLVGEEVMENWTVRELLLLQVEEQKTLSVRQFHYQAWPDHGVPSSPDTLLAFWRMLRQWLDQTMEGGPPIVHCSAGVGRTGTLIALDVLLRQLQSEGLLGPFSFVRKMRESRPLMVQTEAQYVFLHQCILRFLQQSAQAPAEKEVPYEDVENLIYENVAAIQAHKLEV

SEQ ID NO: 60153 - protein, 425 aa, Homo sapiens
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLR

SEQ ID NO: 60154 - protein, 1337 aa, Homo sapiens
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTVPSAVFDIHVVYVTTTEMWLDWKSPDGASEYVYHLVIESKHGSNHTSTYDKAITLQGLIPGTLYNITISPEVDHVWGDPNSTAQYTRPSNVSNIDVSTNTTAATLSWQNFDDASPTYSYCLLIEKAGNSSNATQVVTDIGITDATVTELIPGSSYTVEIFAQVGDGIKSLEPGRKSFCTDPASMASFDCEVVPKEPALVLKWTCPPGANAGFELEVSSGAWNNATHLESCSSENGTEYRTEVTYLNFSTSYNISITTVSCGKMAAPTRNTCTTGITDPPPPDGSPNITSVSHNSVKVKFSGFEASHGPIKAYAVILTTGEAGHPSADVLKYTYEDFKKGASDTYVTYLIRTEEKGRSQSLSEVLKYEIDVGNESTTLGYYNGKLEPLGSYRACVAGFTNITFHPQNKGLIDGAESYVSFSRYSDAVSLPQDPGVICGAVFGCIFGALVIVTVGGFIFWRKKRKDAKNNEVSFSQIKPKKSKLIRVENFEAYFKKQQADSNCGFAEEYEDLKLVGISQPKYAAELAENRGKNRYNNVLPYDISRVKLSVQTHSTDDYINANYMPGYHSKKDFIATQGPLPNTLKDFWRMVWEKNVYAIIMLTKCVEQGRTKCEEYWPSKQAQDYGDITVAMTSEIVLPEWTIRDFTVKNIQTSESHPLRQFHFTSWPDHGVPDTTDLLINFRYLVRDYMKQSPPESPILVHCSAGVGRTGTFIAIDRLIYQIENENTVDVYGIVYDLRMHRPLMVQTEDQYVFLNQCVLDIVRSQKDSKVDLIYQNTTAMTIYENLAPVTTFGKTNGYIA

SEQ ID NO: 60155 - protein, 539 aa, Homo sapiens
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRLQVNISGLKPGVQYNINPYLLQSNKTKGDPLGTEGGLDASNTERSRAGSPTAPVHDESLVGPVDPSSGQQSRDTEVLLVGLEPGTRYNATVYSQAANGTEGQPQAIEFRTNAIQVFDVTAVNISATSLTLIWKVSDNESSSNYTYKIHVAGETDSSNLNVSEPRAVIPGLRSSTFYNITVCPVLGDIEGTPGFLQVHTPPVPVSDFRVTVVSTTEIGLAWSSHDAESFQMHITQEGAGNSRVEITTNQSIIIGGLFPGTKYCFEIVPKGPNGTEGASRTVCNRTG

SEQ ID NO: 60156 - protein, 1472 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKRRSYYSYSYYLKLAKKRKDAMGNTRQEMTHMVNAMDRSYADQSTLHAEDPLSITFMDQHNFSPRLPNDPLVPTAVLVPITDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 60157 - protein, 1458 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRLPNDPLVPTAVLDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 60158 - protein, 1446 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 60159 - protein, 1439 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 60160 - protein, 1440 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRYENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 60161 - protein, 1457 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRLPNDPLVPTAVLDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDVSIFIGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 60162 - protein, 747 aa, Homo sapiens
MTLNGCMLVLKSLIIYHPRCPKVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKRYICWRRHICIRNIRRSYYSYSYYLKLAKKRKDAMGNTRQEMTHMVNAMDRSYADQSTLHAEDPLSITFMDQHNFSPRLPNDPLVPTAVLVPSPGRKNVYHGDNNSFFAISYL

SEQ ID NO: 60163 - protein, 1462 aa, Homo sapiens
MDTTAAAALPAFVALLLLSPWPLLGSAQGQFSAGGCTFDDGPGACDYHQDLYDDFEWVHVSAQEPHYLPPEMPQGSYMIVDSSDHDPGEKARLQLPTMKENDTHCIDFSYLLYSQKGLNPGTLNILVRVNKGPLANPIWNVTGFTGRDWLRAELAVSTFWPNEYQVIFEAEVSGGRSGYIAIDDIQVLSYPCDKSPHFLRLGDVEVNAGQNATFQCIATGRDAVHNKLWLQRRNGEDIPVAQTKNINHRRFAASFRLQEVTKTDQDLYRCVTQSERGSGVSNFAQLIVREPPRPIAPPQLLGVGPTYLLIQLNANSIIGDGPIILKEVEYRMTSGSWTETHAVNAPTYKLWHLDPDTEYEIRVLLTRPGEGGTGLPGPPLITRTKCAEPMRTPKTLKIAEIQARRIAVDWESLGYNITRCHTFNVTICYHYFRGHNESKADCLDMDPKAPQHVVNHLPPYTNVSLKMILTNPEGRKESEETIIQTDEDVPGPVPVKSLQGTSFENKIFLNWKEPLDPNGIITQYEISYSSIRSFDPAVPVAGPPQTVSNLWNSTHHVFMHLHPGTTYQFFIRASTVKGFGPATAINVTTNISAPTLPDYEGVDASLNETATTITVLLRPAQAKGAPISAYQIVVEELHPHRTKREAGAMECYQVPVTYQNAMSGGAPYYFAAELPPGNLPEPAPFTVGDNRTYQGFWNPPLAPRKGYNIYFQAMSSVEKETKTQCVRIATKAAATEEPEVIPDPAKQTDRVVKIAGISAGILVFILLLLVVILIVKKSKLAKKRKDAMGNTRQEMTHMVNAMDRSYADQSTLHAEDPLSITFMDQHNFSPRLPNDPLVPTAVLVPITDENHSATAESSRLLDVPRYLCEGTESPYQTGQLHPAIRVADLLQHINLMKTSDSYGFKEEYESFFEGQSASWDVAKKDQNRAKNRYGNIIAYDHSRVILQPVEDDPSSDYINANYIDIWLYRDGYQRPSHYIATQGPVHETVYDFWRMIWQEQSACIVMVTNLVEVGRVKCYKYWPDDTEVYGDFKVTCVEMEPLAEYVVRTFTLERRGYNEIREVKQFHFTGWPDHGVPYHATGLLSFIRRVKLSNPPSAGPIVVHCSAGAGRTGCYIVIDIMLDMAEREGVVDIYNCVKALRSRRINMVQTEEQYIFIHDAILEACLCGETAIPVCEFKAAYFDMIRIDSQTNSSHLKDEFQTLNSVTPRLQAEDCSIACLPRNHDKNRFMDMLPPDRCLPFLITIDGESSNYINAALMDSYRQPAAFIVTQYPLPNTVKDFWRLVYDYGCTSIVMLNEVDLSQGCPQYWPEEGMLRYGPIQVECMSCSMDCDVINRIFRICNLTRPQEGYLMVQQFQYLGWASHREVPGSKRSFLKLILQVEKWQEECEEGEGRTIIHCLNGGGRSGMFCAIGIVVEMVKRQNVVDVFHAVKTLRNSKPNMVEAPEQYRFCYDVALEYLESS

SEQ ID NO: 60164 - protein, 1452 aa, Homo sapiens
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 60165 - protein, 1390 aa, Homo sapiens
MPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 60166 - protein, 1466 aa, Homo sapiens
MRGLGTCLATLAGLLLTAAGETFSGGCLFDEPYSTCGYSQSEGDDFNWEQVNTLTKPTSDPWMPSGSFMLVNASGRPEGQRAHLLLPQLKENDTHCIDFHYFVSSKSNSPPGLLNVYVKVNNGPLGNPIWNISGDPTRTWNRAELAISTFWPNFYQVIFEVITSGHQGYLAIDEVKVLGHPCTRTPHFLRIQNVEVNAGQFATFQCSAIGRTVAGDRLWLQGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDPFVPTAILDFSLNNETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 60167 - protein, 1239 aa, Homo sapiens
MGTLSLHPGIDVRDAPLKEIKVTSSRRFIASFNVVNTTKRDAGKYRCMIRTEGGVGISNYAELVVKEPPVPIAPPQLASVGATYLWIQLNANSINGDGPIVAREVEYCTASGSWNDRQPVDSTSYKIGHLDPDTEYEISVLLTRPGEGGTGSPGPALRTRTKCADPMRGPRKLEVVEVKSRQITIRWEPFGYNVTRCHSYNLTVHYCYQVGGQEQVREEVSWDTENSHPQHTITNLSPYTNVSVKLILMNPEGRKESQELIVQTDEDLPGAVPTESIQGSTFEEKIFLQWREPTQTYGVITLYEITYKAVSSFDPEIDLSNQSGRVSKLGNETHFLFFGLYPGTTYSFTIRASTAKGFGPPATNQFTTKISAPSMPAYELETPLNQTDNTVTVMLKPAHSRGAPVSVYQIVVEEERPRRTKKTTEILKCYPVPIHFQNASLLNSQYYFAAEFPADSLQAAQPFTIGDNKTYNGYWNTPLLPYKSYRIYFQAASRANGETKIDCVQVATKGAATPKPVPEPEKQTDHTVKIAGVIAGILLFVIIFLGVVLVMKKRKLAKKRKETMSSTRQEMTVMVNSMDKSYAEQGTNCDEAFSFMDTHNLNGRSVSSPSSFTMKTNTLSTSVPNSYYPDETHTMASDTSSLVQSHTYKKREPADVPYQTGQLHPAIRVADLLQHITQMKCAEGYGFKEEYESFFEGQSAPWDSAKKDENRMKNRYGNIIAYDHSRVRLQTIEGDTNSDYINGNYIDGYHRPNHYIATQGPMQETIYDFWRMVWHENTASIIMVTNLVEVGRVKCCKYWPDDTEIYKDIKVTLIETELLAEYVIRTFAVEKRGVHEIREIRQFHFTGWPDHGVPYHATGLLGFVRQVKSKSPPSAGPLVVHCSAGAGRTGCFIVIDIMLDMAEREGVVDIYNCVRELRSRRVNMVQTEEQYVFIHDAILEACLCGDTSVPASQVRSLYYDMNKLDPQTNSSQIKEEFRTLNMVTPTLRVEDCSIALLPRNHEKNRCMDILPPDRCLPFLITIDGESSNYINAALMDSYKQPSAFIVTQHPLPNTVKDFWRLVLDYHCTSVVMLNDVDPAQLCPQYWPENGVHRHGPIQVEFVSADLEEDIISRIFRIYNAARPQDGYRMVQQFQFLGWPMYRDTPVSKRSFLKLIRQVDKWQEEYNGGEGRTVVHCLNGGGRSGTFCAISIVCEMLRHQRTVDVFHAVKTLRNNKPNMVDLLDQYKFCYEVALEYLNSG

SEQ ID NO: 60168 - protein, 979 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 60169 - protein, 950 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQNVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 60170 - protein, 162 aa, Homo sapiens
MRRPRRPGGLGGSGGLRLLLCLLLLSSRPGGCSAVSAHGCLFDRRLCSHLEVCIQDGLFGQCQVGVGQARPLLQVTSPVLQRLQGVLRQLMSQGLSWHDDLTQYVISQEMERIPRLRPPEPRPRDRSGLAPKRPGPAGELLLQDIPTGSAPAAQLLSVPSAG

SEQ ID NO: 60171 - protein, 889 aa, Homo sapiens
MSQGLSWHDDLTQYVISQEMERIPRLRPPEPRPRDRSGLAPKRPGPAGELLLQDIPTGSAPAAQHRLPQPPVGKGGAGASSSLSPLQAELLPPLLEHLLLPPQPPHPSLSYEPALLQPYLFHQFGSRDGSRVSEGSPGMVSVGPLPKAEAPALFSRTASKGIFGDHPGHSYGDLPGPSPAQLFQDSGLLYLAQELPAPSRARVPRLPEQGSSSRAEDSPEGYEKEGLGDRGEKPASPAVQPDAALQRLAAVLAGYGVELRQLTPEQLSTLLTLLQLLPKGAGRNPGGVVNVGADIKKTMEGPVEGRDTAELPARTSPMPGHPTASPTSSEVQQVPSPVSSEPPKAARPPVTPVLLEKKSPLGQSQPTVAGQPSARPAAEEYGYIVTDQKPLSLAAGVKLLEILAEHVHMSSGSFINISVVGPALTFRIRHNEQNLSLADVTQQAGLVKSELEAQTGLQILQTGVGQREEAAAVLPQTAHSTSPMRSVLLTLVALAGVAGLLVALAVALCVRQHARQQDKERLAALGPEGAHGDTTFEYQDLCRQHMATKSLFNRAEGPPEPSRVSSVSSQFSDAAQASPSSHSSTPSWCEEPAQANMDISTGHMILAYMEDHLRNRDRLAKEWQALCAYQAEPNTCATAQGEGNIKKNRHPDFLPYDHARIKLKVESSPSRSDYINASPIIEHDPRMPAYIATQGPLSHTIADFWQMVWESGCTVIVMLTPLVEDGVKQCDRYWPDEGASLYHVYEVNLVSEHIWCEDFLVRSFYLKNVQTQETRTLTQFHFLSWPAEGTPASTRPLLDFRRKVNKCYRGRSCPIIVHCSDGAGRTGTYILIDMVLNRMAKGVKEIDIAATLEHVRDQRPGLVRSKDQFEFALTAVAEEVNAILKALPQ

SEQ ID NO: 60172 - protein, 950 aa, Homo sapiens; identical to SEQ ID NO: 60169

SEQ ID NO: 60173 - protein, 986 aa, Homo sapiens
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDREVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 60174 - protein, 998 aa, Homo sapiens
MGPPLPLLLLLLLLLPPRVLPAAPSSVPRGRQLPGRLDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 60175 - protein, 1015 aa, Homo sapiens
MGPPLPLLLLLLLLLPPRVLPAAPSSVPRGRQLPGRLGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 60176 - protein, 1038 aa, Homo sapiens
MAVESEYSLLRTEASFPTMKMFCVSHTLPRVEVMFVSGPQTRERTEPVDPRWQCLVQMWAGCLLEEGLCGASEACVNDGVFGRCQKVPAMDFYRYEVSPVALQRLRVALQKLSGTGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 60177 - protein, 977 aa, Homo sapiens
MGPPLPLLLLLLLLLPPRVLPAAPSSVPRGRQLPGRLGCLLEEGLCGASEACVNGFTWQDDYTQYVMDQELADLPKTYLRRPEASSPARPSKHSVGSERRYSREGGAALANALRRHLPFLEALSQAPASDVLARTHTAQDRPPAEGDDRFSESILTYVAHTSALTYPPGSRTQLREDLLPRTLGQLQPDELSPKVDSGVDRHHLMAALSAYAAQRPPAPPGEGSLEPQYLLRAPSRMPRPLLAPAAPQKWPSPLGDSEDPSSTGDGARIHTLLKDLQRQPAEVRGLSGLELDGMAELMAGLMQGVDHGVARGSPGRAALGESGEQADGPKATLRGDSFPDDGVQDDDDRLYQEVHRLSATLGGLLQDHGSRLLPGALPFARPLDMERKKSEHPESSLSSEEETAGVENVKSQTYSKDLLGQQPHSEPGAAAFGELQNQMPGPSKEEQSLPAGAQEALSDGLQLEVQPSEEEARGYIVTDRDPLRPEEGRRLVEDVARLLQVPSSAFADVEVLGPAVTFKVSANVQNVTTEDVEKATVDNKDKLEETSGLKILQTGVGSKSKLKFLPPQAEQEDSTKFIALTLVSLACILGVLLASGLIYCLRHSSQHRLKEKLSGLGGDPGADATAAYQELCRQRMATRPPDRPEGPHTSRISSVSSQFSDGPIPSPSARSSASSWSEEPVQSNMDISTGHMILSYMEDHLKNKNRLEKEWEALCAYQAEPNSSFVAQREENVPKNRSLAVLTYDHSRVLLKAENSHSHSDYINASPIMDHDPRNPAYIATQGPLPATVADFWQMVWESGCVVIVMLTPLAENGVRQCYHYWPDEGSNLYHIYEVNLVSEHIWCEDFLVRSFYLKNLQTNETRTVTQFHFLSWYDRGVPSSSRSLLDFRRKVNKCYRGRSCPIIVHCSDGAGRSGTYVLIDMVLNKMAKGAKEIDIAATLEHLRDQRPGMVQTKEQFEFALTAVAEEVNAILKALPQ

SEQ ID NO: 60178 - protein, 1216 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 60179 - protein, 1188 aa, Homo sapiens
MGHLPTGIHGARRLLPLLWLFVLFKNATAFHVTVQDDNNIVVSLEASDVISPASVYVVKITGESKNYFFEFEEFNSTLPPPVIFKASYHGLYYIITLVVVNGNVVTKPSRSITVLTKPLPVTSVSIYDYKPSPETGVLFEIHYPEKYNVFTRVNISYWEGKDFRTMLYKDFFKGKTVFNHWLPGMCYSNITFQLVSEATFNKSTLVEYSGVSHEPKQHRTAPYPPQNISVRIVNLNKNNWEEQSGNFPEESFMRSQDTIGKEKLFHFTEETPEIPSGNISSGWPDFNSSDYETTSQPYWWDSASAAPESEDEFVSVLPMEYENNSTLSETEKSTSGSFSFFPVQMILTWLPPKPPTAFDGFHIHIEREENFTEYLMVDEEAHEFVAELKEPGKYKLSVTTFSSSGSCETRKSQSAKSLSFYISPSGEWIEELTEKPQHVSVHVLSSTTALMSWTSSQENYNSTIVSVVSLTCQKQKESQRLEKQYCTQVNSSKPIIENLVPGAQYQVVIYLRKGPLIGPPSDPVTFAIVPTGIKDLMLYPLGPTAVVLSWTRPYLGVFRKYVVEMFYFNPATMTSEWTTYYEIAATVSLTASVRIANLLPAWYYNFRVTMVTWGDPELSCCDSSTISFITAPVAPEITSVEYFNSLLYISWTYGDDTTDLSHSRMLHWMVVAEGKKKIKKSVTRNVMTAILSLPPGDIYNLSVTACTERGSNTSMLRLVKLEPAPPKSLFAVNKTQTSVTLLWVEEGVADFFEVFCQQVGSSQKTKLQEPVAVSSHVVTISSLLPATAYNCSVTSFSHDSPSVPTFIAVSTMVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 60180 - protein, 405 aa, Homo sapiens
MVTEMNPNVVVISVLAILSTLLIGLLLVTLIILRKKHLQMARECGAGTFVNFASLERDGKLPYNWRRSIFAFLTLLPSCLWTDYLLAFYINPWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 60181 - protein, 405 aa, Homo sapiens; identical to SEQ ID NO: 60180

SEQ ID NO: 60182 - protein, 377 aa, Homo sapiens
MVTEMNPNVVVISVLAILSTLLIGLLLVTLIILRKKHLQMARECGAGTFVNFASLERDGKLPYNWSKNGLKKRKLTNPVQLDDFDAYIKDMAKDSDYKFSLQFEELKLIGLDIPHFAADLPLNRCKNRYTNILPYDFSRVRLVSMNEEEGADYINANYIPGYNSPQEYIATQGPLPETRNDFWKMVLQQKSQIIVMLTQCNEKRRVKCDHYWPFTEEPIAYGDITVEMISEEEQDDWACRHFRINYADEMQDVMHFNYTAWPDHGVPTANAAESILQFVHMVRQQATKSKGPMIIHCSAGVGRTGTFIALDRLLQHIRDHEFVDILGLVSEMRSYRMSMVQTEEQYIFIHQCVQLMWMKKKQQFCISDVIYENVSKS

SEQ ID NO: 60183 - protein, 377 aa, Homo sapiens; identical to SEQ ID NO: 60182

SEQ ID NO: 60184 - protein, 2295 aa, Homo sapiens
MDFLIIFLLLFIGTSETQVDVSNVVPGTRYDITISSISTTYTSPVTRIVTTNVTKPGPPVFLAGERVGSAGILLSWNTPPNPNGRIISYIVKYKEVCPWMQTVYTQVRSKPDSLEVLLTNLNPGTTYEIKVIILNATKVGCLLSPILLNTVLEGLARAINLTRECQTVDAGQCVQCAVREPKQGSTSGGRAQTNKKTAVTSADLNHTAGDLRTGRLPPQPLTAEQPNWEAPPSRGRLTPHKAGYSSATAAGTQANRVWSRPLAKIQTTIREYYKHLYAKKEGILPNSFYEASIILIPKPVPEGPPQNCVTGNITGKSFSILWDPPTIVTGKFSYRVELYGPSGRILDNSTKDLKFAFTNLTPFTMYDVYIAAETSAGTGPKSNISVFTPPDVPGAVFDLQLAEVESTQVRITWKKPRQPNGIINQYRVKVLVPETGIILENTLLTGNNEYINDPMAPEIVNIVEPMVGLYEGSAEMSSDLHSLATFIYNSHPDKNFPARNRAEDQTSPVVTTRNQYITDIAAEQLSYVIRRLVPFTEHMISVSAFTIMGEGPPTVLSVRTRQQVPSSIKIINYKNISSSSILLYWDPPEYPNGKITHYTIYAMELDTNRAFQITTIDNSFLITGLKKYTKYKMRVAASTHVGESSLSEENDIFVRTSEDEPESSPQDVEVIDVTADEIRLKWSPPEKPNGIIIAYEVLYKNIDTLYMKNTSTTDIILRNLRPHTLYNISVRSYTRFGHGNQVSSLLSVRTSETVPDSAPENITYKNISSGEIELSFLPPSSPNGIIQKYTIYLKRSNGNEERTINTTSLTQNIKVLKKYTQYIIEVSASTLKGEGVRSAPISILTEEDAPDSPPQDFSVKQLSGVTVKLSWQPPLEPNGIILYYTVYVWNRSSLKTINVTETSLELSDLDYNVEYSAYVTASTRFGDGKTRSNIISFQTPEGAPSDPPKDVYYANLSSSSIILFWTPPSKPNGIIQYYSVYYRNTSGTFMQNFTLHEVTNDFDNMTVSTIIDKLTIFSYYTFWLTASTSVGNGNKSSDIIEVYTDQDIPEGFVGNLTYESISSTAINVSWVPPAQPNGLVFYYVSLILQQTPRHVRPPLVTYERSIYFDNLEKYTDYILKITPSTEKGFSDTYTAQLYIKTEEDVPETSPIINTFKNLSSTSVLLSWDPPVKPNGAIISYDLTLQGPNENYSFITSDNYIILEELSPFTLYSFFAAARTRKGLGPSSILFFYTDESVPLAPPQNLTLINCTSDFVWLKWSPSPLPGGIVKVYSFKIHEHETDTIYYKNISGFKTEAKLVGLEPVSTYSIRVSAFTKVGNGNQFSNVVKFTTQESVPDVVQNMQCMATSWQSVLVKWDPPKKANGIITQYMVTVERNSTKVSPQDHMYTFIKLLANTSYVFKVRASTSAGEGDESTCHVSTLPETVPSVPTNIAFSDVQSTSATLTWIRPDTILGYFQNYKITTQLRAQKCKEWESEECVEYQKIQYLYEAHLTEETVYGLKKFRWYRFQVAASTNAGYGNASNWISTKTLPGPPDGPPENVHVVATSPFSISISWSEPAVITGPTCYLIDVKSVDNDEFNISFIKSNEENKTIEIKDLEIFTRYSVVITAFTGNISAAYVEGKSSAEMIVTTLESAPKDPPNNMTFQKIPDEVTKFQLTFLPPSQPNGNIQVYQALVYREDDPTAVQIHNLSIIQKTNTFVIAMLEGLKGGHTYNISVYAVNSAGAGPKVPMRITMDIKAPARPKTKPTPIYDATGKLLVTSTTITIRMPICYYSDDHGPIKNVQVLVTETGAQHDGNVTKWYDAYFNKARPYFTNEGFPNPPCTEGKTKFSGNEEIYIIGADNACMIPGNEDKICNGPLKPKKQYLFKFRATNIMGQFTDSDYSDPVKTLGEGLSERTVEIILSVTLCILSIILLGTAIFAFARIRQKQKEGGTYSPQDAEIIDTKLKLDQLITVADLELKDERLTRLLSYRKSIKPISKKSFLQHVEELCTNNNLKFQEEFSELPKFLQDLSSTDADLPWNRAKNRFPNIKPYNNNRVKLIADASVPGSDYINASYISGYLCPNEFIATQGPLPGTVGDFWRMVWETRAKTLVMLTQCFEKGRIRCHQYWPEDNKPVTVFGDIVITKLMEDVQIDWTIRDLKIERHGDCMTVRQCNFTAWPEHGVPENSAPLIHFVKLVRASRAHDTTPMIVHCSAGVGRTGVFIALDHLTQHINDHDFVDIYGLVAELRSERMCMVQNLAQYIFLHQCILDLLSNKGSNQPICFVNYSALQKMDSLDAMEGDVELEWEETTM

SEQ ID NO: 60185 - protein, 1928 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSDQAFSHLPTGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60186 - protein, 1910 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60187 - protein, 1501 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60188 - protein, 1948 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSDQAFSHLPTGALQIESSEETDQGKYECVATNSAGVRYSSPANLYVRVWRTVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60189 - protein, 1530 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSDQAFSHLPTGALQIESSEETDQGKYECVATNSAGVRYSSPANLYVRVWRTVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60190 - protein, 1939 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSDQAFSHLPTGALQIESSEETDQGKYECVATNSAGVRYSSPANLYVRVWRTVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60191 - protein, 1948 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSETFESTPIRGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60192 - protein, 1949 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRRSETFESTPIRGALQIESSEETDQGKYECVATNSAGVRYSSPANLYVRELREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSKPSAPPQDVKCVSVRSTAILVSWRPPPPETHNGALVGYSVRYRPLGSEDPEPKEVNGIPPTTTQILLEALEKWTQYRITTVAHTEVGPGPESSPVVVRTDEDVPSAPPRKVEAEALNATAIRVLWRSPAPGRQHGQIRGYQVHYVRMEGAEARGPPRIKDVMLADAQWETDDTAEYEMVITNLQPETAYSITVAAYTMKGDGARSKPKVVVTKGAVLGRPTLSVQQTPEGSLLARWEPPAGTAEDQVLGYRLQFGREDSTPLATLEFPPSEDRYTASGVHKGATYVFRLAARSRGGLGEEAAEVLSIPEDTPRGHPQILEAAGNASAGTVLLRWLPPVPAERNGAIVKYTVAVREAGALGPARETELPAAAEPGAENALTLQGLKPDTAYDLQVRAHTRRGPGPFSPPVRYRTFLRDQVSPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKKKPHSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60193 - protein, 1560 aa, Homo sapiens
RSARGLSVRDRGAIPLQGGDRRSLPSMAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPDSGLRSPLREPGFHFESMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTETESRPGWSAVAQSRLTASSASWIHAILLPQPPEWLGLQV

SEQ ID NO: 60194 - protein, 1505 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSGALQIESSEETDQGKYECVATNSAGVRYSSPANLYVRALREVRRVAPRFSILPMSHEIMPGGNVNITCVAVGSPMPYVKWMQGAEDLTPEDDMPVGRNVLELTDVKDSANYTCVAMSSLGVIEAVAQITVKSLPKAPGTPMVTENTATSITITWDSGNPDPVSYYVIEYKSKSQDGPYQIKEDITTTRYSIGGLSPNSEYEIWVSAVNSIGQGPPSESVVTRTGEQAPASAPRNVQARMLSATTMIVQWEEPVEPNGLIRGYRVYYTMEPEHPVGNWQKHNVDDSLLTTVGSLLEDETYTVRVLAFTSVGDGPLSDPIQVKTQQGVPGQPMNLRAEARSETSITLSWSPPRQESIIKYELLFREGDHGREVGRTFDPTTSYVVEDLKPNTEYAFRLAARSPQGLGAFTPVVRQRTLQSISPKNFKVKMIMKTSVLLSWEFPDNYNSPTPYKIQYNGLTLDVDGRTTKKLITHLKPHTFYNFVLTNRGSSLGGLQQTVTAWTAFNLLNGKPSVAPKPDADGFIMVYLPDGQSPVPVQSYFIVMVPLRKSRGGQFLTPLGSPEDMDLEELIQDISRLQRRSLRHSRQLEVPRPYIAARFSVLPPTFHPGDQKQYGGFDNRGLEPGHRYVLFVLAVLQKSEPTFAASPFSDPFQLDNPDPQPIVDGEEGLIWVIGPVLAVVFIICIVIAILLYKNKPDSKRKDSEPRTKCLLNNADLAPHHPKDPVEMRRINFQTPGMLSHPPIPIADMAEHTERLKANDSLKLSQEYESIDPGQQFTWEHSNLEVNKPKNRYANVIAYDHSRVILQPIEGIMGSDYINANYVDGYRCQNAYIATQGPLPETFGDFWRMVWEQRSATIVMMTRLEEKSRIKCDQYWPNRGTETYGFIQVTLLDTIELATFCVRTFSLHKNGSSEKREVRQFQFTAWPDHGVPEYPTPFLAFLRRVKTCNPPDAGPIVVHCSAGVGRTGCFIVIDAMLERIKPEKTVDVYGHVTLMRSQRNYMVQTEDQYSFIHEALLEAVGCGNTEVPARSLYAYIQKLAQVEPGEHVTGMELEFKRLANSKAHTSRFISANLPCNKFKNRLVNIMPYESTRVCLQPIRGVEGSDYINASFIDGYRQQKAYIATQGPLAETTEDFWRMLWENNSTIVVMLTKLREMGREKCHQYWPAERSARYQYFVVDPMAEYNMPQYILREFKVTDARDGQSRTVRQFQFTDWPEQGVPKSGEGFIDFIGQVHKTKEQFGQDGPISVHCSAGVGRTGVFITLSIVLERMRYEGVVDIFQTVKMLRTQRPAMVQTEDEYQFCYQAALEYLGSFDHYAT

SEQ ID NO: 60195 - protein, 1442 aa, Homo sapiens
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDLRGGRTGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 60196 - protein, 1446 aa, Homo sapiens
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGRDHYAYSYYPKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 60197 - protein, 1442 aa, Homo sapiens
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDIRINREGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 60198 - protein, 1436 aa, Homo sapiens
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVGRVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 60199 - protein, 1433 aa, Homo sapiens
MARAQALVLALTFQLCAPETETPAAGCTFEEASDPAVPCEYSQAQYDDFQWEQVRIHPGTRAPADLPHGSYLMVNTSQHAPGQRAHVIFQSLSENDTHCVQFSYFLYSRDGHSPGTLGVYVRVNGGPLGSAVWNMTGSHGRQWHQAELAVSTFWPNEYQVLFEALISPDRRGYMGLDDILLLSYPCAKAPHFSRLGDVEVNAGQNASFQCMAAGRAAEAERFLLQRQSGALVPAAGVRHISHRRFLATFPLAAVSRAEQDLYRCVSQAPRGAGVSNFAELIVKEPPTPIAPPQLLRAGPTYLIIQLNTNSIIGDGPIVRKEIEYRMARGPWAEVHAVSLQTYKLWHLDPDTEYEISVLLTRPGDGGTGRPGPPLISRTKCAEPMRAPKGLAFAEIQARQLTLQWEPLGYNVTRCHTYTVSLCYHYTLGSSHNQTIRECVKTEQGVSRYTIKNLLPYRNVHVRLVLTNPEGRKEGKEVTFQTDEDVPSGIAAESLTFTPLEDMIFLKWEEPQEPNGLITQYEISYQSIESSDPAVNVPGPRRTISKLRNETYHVFSNLHPGTTYLFSVRARTGKGFGQAALTEITTNISAPSFDYADMPSPLGESENTITVLLRPAQGRGAPISVYQVIVEEERARRLRREPGGQDCFPVPLTFEAALARGLVHYFGAELAASSLPEAMPFTVGDNQTYRGFWNPPLEPRKAYLIYFQAASHLKGETRLNCIRIARKAACKESKRPLEVSQRSEEMGLILGICAGGLAVLILLLGAIIVIIRKGKPVNMTKATVNYRQEKTHMMSAVDRSFTDQSTLQEDERLGLSFMDTHGYSTRGDQRSGGVTEASSLLGGSPRRPCGRKGSPYHTGQLHPAVRVADLLQHINQMKTAEGYGFKQEYESFFEGWDATKKKDKVKGSRQEPMPAYDRHRVKLHPMLGDPNADYINANYIDGYHRSNHFIATQGPKPEMVYDFWRMVWQEHCSSIVMITKLVEVKCSRYWPEDSDTYGDIKIMLVKTETLAEYVVRTFALERRGYSARHEVRQFHFTAWPEHGVPYHATGLLAFIRRVKASTPPDAGPIVIHCSAGTGRTGCYIVLDVMLDMAECEGVVDIYNCVKTLCSRRVNMIQTEEQYIFIHDAILEACLCGETTIPVSEFKATYKEMIRIDPQSNSSQLREEFQTLNSVTPPLDVEECSIALLPRNRDKNRSMDVLPPDRCLPFLISTDGDSNNYINAALTDSYTRSAAFIVTLHPLQSTTPDFWRLVYDYGCTSIVMLNQLNQSNSAWPCLQYWPEPGRQQYGLMEVEFMSGTADEDLVARVFRVQNISRLQEGHLLVRHFQFLRWSAYRDTPDSKKAFLHLLAEVDKWQAESGDGRTIVHCLNGGGRSGTFCACATVLEMIRCHNLVDVFFAAKTLRNYKPNMVETMDQYHFCYDVALEYLEGLESR

SEQ ID NO: 60200 - protein, 2315 aa, Homo sapiens
MRILKRFLACIQLLCVCRLDWANGYYRQQRKLVEEIGWSYTGALNQKNWGKKYPTCNSPKQSPINIDEDLTQVNVNLKKLKFQGWDKTSLENTFIHNTGKTVEINLTNDYRVSGGVSEMVFKASKITFHWGKCNMSSDGSEHSLEGQKFPLEMQIYCFDADRFSSFEEAVKGKGKLRALSILFEVGTEENLDFKAIIDGVESVSRFGKQAALDPFILLNLLPNSTDKYYIYNGSLTSPPCTDTVDWIVFKDTVSISESQLAVFCEVLTMQQSGYVMLMDYLQNNFREQQYKFSRQVFSSYTGKEEIHEAVCSSEPENVQADPENYTSLLVTWERPRVVYDTMIEKFAVLYQQLDGEDQTKHEFLTDGYQDLGAILNNLLPNMSYVLQIVAICTNGLYGKYSDQLIVDMPTDNPELDLFPELIGTEEIIKEEEEGKDIEEGAIVNPGRDSATNQIRKKEPQISTTTHYNRIGTKYNEAKTNRSPTRGSEFSGKGDVPNTSLNSTSQPVTKLATEKDISLTSQTVTELPPHTVEGTSASLNDGSKTVLRSPHMNLSGTAESLNTVSITEYEEESLLTSFKLDTGAEDSSGSSPATSAIPFISENISQGYIFSSENPETITYDVLIPESARNASEDSTSSGSEESLKDPSMEGNVWFPSSTDITAQPDVGSGRESFLQTNYTEIRVDESEKTTKSFSAGPVMSQGPSVTDLEMPHYSTFAYFPTEVTPHAFTPSSRQQDLVSTVNVVYSQTTQPVYNGETPLQPSYSSEVFPLVTPLLLDNQILNTTPAASSSDSALHATPVFPSVDVSFESILSSYDGAPLLPFSSASFSSELFRHLHTVSQILPQVTSATESDKVPLHASLPVAGGDLLLEPSLAQYSDVLSTTHAASETLEFGSESGVLYKTLMFSQVEPPSSDAMMHARSSGPEPSYALSDNEGSQHIFTVSYSSAIPVHDSVGVTYQGSLFSGPSHIPIPKSSLITPTASLLQPTHALSGDGEWSGASSDSEFLLPDTDGLTALNISSPVSVAEFTYTTSVFGDDNKALSKSEIIYGNETELQIPSFNEMVYPSESTVMPNMYDNVNKLNASLQETSVSISSTKGMFPGSLAHTTTKVFDHEISQVPENNFSVQPTHTVSQASGDTSLKPVLSANSEPASSDPASSEMLSPSTQLLFYETSASFSTEVLLQPSFQASDVDTLLKTVLPAVPSDPILVETPKVDKISSTMLHLIVSNSASSENMLHSTSVPVFDVSPTSHMHSASLQGLTISYASEKYEPVLLKSESSHQVVPSLYSNDELFQTANLEINQAHPPKGRHVFATPVLSIDEPLNTLINKLIHSDEILTSTKSSVTGKVFAGIPTVASDTFVSTDHSVPIGNGHVAITAVSPHRDGSVTSTKLLFPSKATSELSHSAKSDAGLVGGGEDGDTDDDGDDDDDDRGSDGLSIHKCMSCSSYRESQEKVMNDSDTHENSLMDQNNPISYSLSENSEEDNRVTSVSSDSQTGMDRSPGKSPSANGLSQKHNDGKEENDIQTGSALLPLSPESKAWAVLTSDEESGSGQGTSDSLNENETSTDFSFADTNEKDADGILAAGDSEITPGFPQSPTSSVTSENSEVFHVSEAEASNSSHESRIGLAEGLESEKKAVIPLVIVSALTFICLVVLVGILIYWRKCFQTAHFYLEDSTSPRVISTPPTPIFPISDDVGAIPIKHFPKHVADLHASSGFTEEFETLKEFYQEVQSCTVDLGITADSSNHPDNKHKNRYINIVAYDHSRVKLAQLAEKDGKLTDYINANYVDGYNRPKAYIAAQGPLKSTAEDFWRMIWEHNVEVIVMITNLVEKGRRKCDQYWPADGSEEYGNFLVTQKSVQVLAYYTVRNFTLRNTKIKKGSQKGRPSGRVVTQYHYTQWPDMGVPEYSLPVLTFVRKAAYAKRHAVGPVVVHCSAGVGRTGTYIVLDSMLQQIQHEGTVNIFGFLKHIRSQRNYLVQTEEQYVFIHDTLVEAILSKETEVLDSHIHAYVNALLIPGPAGKTKLEKQFQLLSQSNIQQSDYSAALKQCNREKNRTSSIIPVERSRVGISSLSGEGTDYINASYIMGYYQSNEFIITQHPLLHTIKDFWRMIWDHNAQLVVMIPDGQNMAEDEFVYWPNKDEPINCESFKVTLMAEEHKCLSNEEKLIIQDFILEATQDDYVLEVRHFQCPKWPNPDSPISKTFELISVIKEEAANRDGPMIVHDEHGGVTAGTFCALTTLMHQLEKENSVDVYQVAKMINLMRPGVFADIEQYQFLYKVILSLVSTRQEENPSTSLDSNGAALPDGNIAESLESLV

SEQ ID NO: 60201 - protein, 157 aa, Homo sapiens
MGRLTEAAAAGSGSRAAGWAGSPPTLLPLSPTSPRCAATMASSDEDGTNGGASEAGEDREAPGERRRLGVLATAWLTFYDIAMTAGRLILSPRLECIGAISAHCQPQPPEFKRFSCLGLRSSWDYKRGPPRPINFCIFGRDRVSPCWPGWSRTPDLK

SEQ ID NO: 60202 - protein, 288 aa, Homo sapiens
MGRLTEAAAAGSGSRAAGWAGSPPTLLPLSPTSPRCAATMASSDEDGTNGGASEAGEDREAPGERRRLGVLATAWLTFYDIAMTAGWLVLAIAMVRFYMEKGTHRGLYKSIQKTLKFFQTFALLEIVHCLIGIVPTSVIVTGVQVSSRIFMVWLITHSIKPIQNEESVVLFLVAWTVTEITRYSFYTFSLLDHLPYFIKWARYNFFIILYPVGVAGELLTIYAALPHVKKTGMFSIRLPNKYNVSFDYYYFLLITMASYIPLFPQLYFHMLRQRRKVLHGEVIVEKDD

SEQ ID NO: 60203 - protein, 422 aa, Homo sapiens
MAGCVPLLQGLVLVLALHRVEPSATSLKERHGLHSDSACTGVQESLFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 60204 - protein, 400 aa, Homo sapiens
MAGCVPLLQGLVLVLALHRVEPSVFLPASKANDVLVRWKRAGSYLLEELFEGNLEKECYEEICVYEEAREVFENEVVTDEFWRRYKGGSPCISQPCLHNGSCQDSIWGYTCTCSPGYEGSNCELAKNECHPERTDGCQHFCLPGQESYTCSCAQGYRLGEDHKQCVPHDQCACGVLTSEKRAPDLQDLPWQVKLTNSEGKDFCGGVIIRENFVLTTAKCSLLHRNITVKTYFNRTSQDPLMIKITHVHVHMRYDADAGENDLSLLELEWPIQCPGAGLPVCTPEKDFAEHLLIPRTRGLLSGWARNGTDLGNSLTTRPVTLVEGEECGQVLNVTVTTRTYCERSSVAAMHWMDGSVVTREHRGSWFLTGVLGSQPVGGQAHMVLVTKVSRYSLWFKQIMN

SEQ ID NO: 60205 - protein, 256 aa, Homo sapiens
MAHRPPSPALASVLLALLLSGAARAAEIVGGHEAQPHSRPYMASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 60206 - protein, 215 aa, Homo sapiens
MASLQMRGNPGSHFCGGTLIHPSFVLTAAHCLRDIPQRLVNVVLGAHNVRTQEPTQQHFSVAQVFLNNYDAENKLNDVLLIQLSSPANLSASVATVQLPQQDQPVPHGTQCLAMGWGRVGAHDPPAQVLQELNVTVVTFFCRPHNICTFVPRRKAGICFGDSGGPLICDGIIQGIDSFVIWGCATRLFPDFFTRVALYVDWIRSTLRRVEAKGRP

SEQ ID NO: 60207 - protein, 285 aa, Homo sapiens
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 60208 - protein, 227 aa, Homo sapiens
MAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 60209 - protein, 286 aa, Homo sapiens
MPGARSGGSGGDGSNSGSYSGDASGAVTVWEVVSLLGKLLGTVVALKVVLYLLRVCLAMAWKSGGASHSELIHNLRKNGIIKTDKVFEVMLATDRSHYAKCNPYMDSPQSIGFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRDEL

SEQ ID NO: 60210 - protein, 285 aa, Homo sapiens; identical to SEQ ID NO: 60207

SEQ ID NO: 60211 - protein, 192 aa, Homo sapiens
MAWKSGGASHSELIHNLRSFQATISAPHMHAYALELLFDQLHEGAKALDVGSGSGILTACFARMVGCTGKVIGIDHIKELVDDSVNNVRKDDPTLLSSGRVQLVVGDGRMGYAEEAPYDAIHVGAAAPVVPQALIDQLKPGGRLILPVGPAGGNQMLEQYDKLQDGSIKMKPLMGVIYVPLTDKEKQWSRWK

SEQ ID NO: 60212 - protein, 671 aa, Homo sapiens
MKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 60213 - protein, 695 aa, Homo sapiens
MWGFLKRPVVVTADINLSLVALTGMGLLSRLWRLTYPRAVVLFRRIRWQFFVEQNWSSVVAFPEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 60214 - protein, 346 aa, Homo sapiens
WRGGGCTSPATLGAARGAVGIGKEGQYQPLIASLTWGLVPLSQAQEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 60215 - protein, 156 aa, Homo sapiens
MAYQIVLELHFSHCAAMGAALLMLIENALITQSRLMLLESVLIFFNLLAVLSYLKFFNCQKHSLPLWAPRPNHVQCLPGQLRGRTSSDHSGSATGGGLWVPGHSEERLWETCALLASFPPGHLPHDVRYENGRGSSHQQQVTCYPFKDVNNWWIVK

SEQ ID NO: 60216 - protein, 747 aa, Homo sapiens
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMQMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 60217 - protein, 725 aa, Homo sapiens
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 60218 - protein, 608 aa, Homo sapiens
MAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 60219 - protein, 156 aa, Homo sapiens; identical to SEQ ID NO: 60215

SEQ ID NO: 60220 - protein, 142 aa, Homo sapiens
MWGFLKRPVVVTADINLSLVALTGMGLLSRLWRLTYPRAVVFDEVYYGQYISFYMKQIFFLDDSGPPFGHMVLALGGYLGGFDGNFLWNRIGAEYSSNVPVWSLRLLPALAGALSVPMAYQIVLELHFSHCAAMGAALLMLI

SEQ ID NO: 60221 - protein, 573 aa, Homo sapiens
MLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQWRMLALRSDDSEHKYSSSPLEWVTLDTNIAYWLHPRTSAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 60222 - protein, 725 aa, Homo sapiens; identical to SEQ ID NO: 60217

SEQ ID NO: 60223 - protein, 168 aa, Homo sapiens
MAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVCVFCHLLARAVALLVIPVVLYLLFFYVHLILVFRSGPHDQIMSSAFQASLE

SEQ ID NO: 60224 - protein, 297 aa, Homo sapiens
MAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMQMSQGVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNT

SEQ ID NO: 60225 - protein, 218 aa, Homo sapiens
MKQIFFLDDSGPPFGHMVLALGGYLGGFDGNFLWNRIGAEYSSNVPVWSLRLLPALAGALSVPMAYQIVLELHFSHCAAMGAALLMLIENALITQSRLMLLESVLIFFNLLAVLSYLKFFNCQKHSPFSLSWWFWLTLTGVACSCAVGIKYMGVFTYVLVLGVAAVHAWHLLGDQTLSNVGADVQCCMRPACMGQMQMSQGVCVFCHLLARAVALLVI

SEQ ID NO: 60226 - protein, 465 aa, Homo sapiens
MAIFCGTELEQVCVFCHLLARAVALLVIPVVLYLLFFYVHLILVFRSGPHDQIMSSAFQASLEGGLARITQGQPLEVAFGSQVTLRNVFGKPVPCWLHSHQDTYPMIYENGRGSSHQQQVTCYPFKDVNNWWIVKDPRRHQLVVSSPPRPVRHGDMVQLVHGMTTRSLNTHDVAAPLSPHSQEVSCYIDYNISMPAQNLWRLEIVNRGSDTDVWKTILSEVRFVHVNTSAVLKLSGAHLPDWGYRQLEIVGEKLSRGYHGSTVWNVEEHRYGASQEQRERERELHSPAQVDVSRNLSFMARFSELQAQIHLLGNIVIWVSGSLALAIYALLSLWYLLRRRRNVHDLPQDAWLRWVLAGALCAGGWAVNYLPFFLMEKTLFLYHYLPALTFQILLLPVVLQHISDHLCRSQLQRSIFSALVVAWYSSACHVSNTLRPLTYGDKSLSPHELKALRWKDSWDILIRKH

SEQ ID NO: 60227 - protein, 750 aa, Homo sapiens
MPPATGGGLAESELRPRRGRCGPQAARAAGRDVAAEAVARSPKRPAWGSRRFEAVGWWALLALVTLLSFATRFHRLDEPPHICWDETHFGKMGSYYINRTFFFDVHPPLGKMLIGLAGYLSGYDGTFLFQKPGDKYEHHSYMGMRGFCAFLGSWLVPFAYLTVLDLSKSLSAALLTAALLTFDTGCLTLSQYILLDPILMFFIMAAMLSMVKYNSCADRPFSAPWWFWLSLTGVSLAGALGVKFVGLFIILQVGLNTIADLWYLFGDLSLSLVTVGKHLTARVLCLIVLPLALYTATFAVHFMVLSKSGPGDGFFSSAFQARLSGNNLHNASIPEHLAYGSVITVKNLRMAIGYLHSHRHLYPEGIGARQQQVTTYLHKDYNNLWIIKKHNTNSDPLDPSFPVEFVRHGDIIRLEHKETSRNLHSHYHEAPMTRKHYQVTGYGINGTGDSNDFWRIEVVNRKFGNRIKVLRSRIRFIHLVTGCVLGSSGKVLPKWGWEQLEVTCTPYLKETLNSIWNVEDHINPKLPNISLDVLQPSFPEILLESHMVMIRGNSGLKPKDNEFTSKPWHWPINYQGLRFSGVNDTDFRVYLLGNPVVWWLNLLSIALYLLSGSIIAVAMQRGARLPAEVAGLSQVLLRGGGQVLLGWTLHYFPFFLMGRVLYFHHYFPAMLFSSMLTGILWDTLLRLCAWGLASWPLARGIHVAGILSLLLGTAYSFYLFHPLAYGMVGPLAQDPQSPMAGLRWLDSWDF

SEQ ID NO: 60228 - protein, 222 aa, Homo sapiens
MKLPLLLALLFGAVSALHLRSETSTFETPLGAKTLPEDEETPEQEMEETPCRELEEEEEWGSGSEDASKKDGAVESISVPDMVDKNLTCPEEEDTVKVVGIPGCQTCRYLLVRSLQTFSQAWFTCRRCYRGNLVSIHNFNINYRIQCSVSALNQGQVWIGGRITGSGRCRRFQWVDGSRWNFAYWAAHQPWSRGGHCVALCTRGGHWRRAHCLRRLPFICSY

SEQ ID NO: 60229 - protein, 222 aa, Homo sapiens; identical to SEQ ID NO: 60228

SEQ ID NO: 60230 - protein, 211 aa, Homo sapiens
MKLPLLLALLFGAVSALHLRSETSTFETPLGAKTLPEDEETPEQEMEETPCRELEEEEEWGSGSEDASKKDGAVESISVPDMVDKNLTCPEEEDTVKVVGIPGCQTCRYLLFTCRRCYRGNLVSIHNFNINYRIQCSVSALNQGQVWIGGRITGSGRCRRFQWVDGSRWNFAYWAAHQPWSRGGHCVALCTRGGHWRRAHCLRRLPFICSY

SEQ ID NO: 60231 - protein, 225 aa, Homo sapiens
MQCLLLLPFLLLGTVSALHLENDAPHLESLETQADLGQDLDSSKEQERDLALTEEVIQAEGEEVKASACQDNFEDEEAMESDPAALDKDFQCPREEDIVEVQGSPRCKICRYLLVRTPKTFAEAQNVCSRCYGGNLVSIHDFNFNYRIQCCTSTVNQAQVWIGGNLRGWFLWKRFCWTDGSHWNFAYWSPGQPGNGQGSCVALCTKGGYWRRAQCDKQLPFVCSF

SEQ ID NO: 60232 - protein, 1363 aa, Homo sapiens
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTCDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 60233 - protein, 933 aa, Homo sapiens
MAWKTLPIYLLLLLSVFVIQQVSSQELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 60234 - protein, 1311 aa, Homo sapiens
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTCDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 60235 - protein, 1361 aa, Homo sapiens
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTCDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 60236 - protein, 1404 aa, Homo sapiens
MAWKTLPIYLLLLLSVFVIQQVSSQDLSSCAGRCGEGYSRDATCNCDYNCQHYMECCPDFKRVCTAELSCKGRCFESFERGRECDCDAQCKKYDKCCPDYESFCAEVHNPTSPPSSKKAPPPSGASQTIKSTTKRSPKPPNKKKTKKVIESEEITEEHSVSENQESSSSSSSSSSSSTIRKIKSSKNSAANRELQKKLKVKDNKKNRTKKKPTPKPPVVDEAGSGLDNGDFKVTTPDTSTTQHNKVSTSPKITTAKPINPRPSLPPNSDTSKETSLTVNKETTVETKETTTTNKQTSTDGKEKTTSAKETQSIEKTSAKDLAPTSKVLAKPTPKAETTTKGPALTTPKEPTPTTPKEPASTTPKEPTPTTIKSAPTTPKEPAPTTTKSAPTTPKEPAPTTTKEPAPTTPKEPAPTTTKEPAPTTTKSAPTTPKEPAPTTPKKPAPTTPKEPAPTTPKEPTPTTPKEPAPTTKEPAPTTPKEPAPTAPKKPAPTTPKEPAPTTPKEPAPTTTKEPSPTTPKEPAPTTTKSAPTTTKEPAPTTTKSAPTTPKEPSPTTTKEPAPTTPKEPAPTTPKKPAPTTPKEPAPTTPKEPAPTTTKKPAPTTPKEPAPTTPKETAPTTPKKLTPTTPEKLAPTTPEKPAPTTPEELAPTTPEEPTPTTPEEPAPTTPKAAAPNTPKEPAPTTPKEPAPTTPKEPAPTTPKETAPTTPKGTAPTTLKEPAPTTPKKPAPKELAPTTTKEPTSTTCDKPAPTTPKGTAPTTPKEPAPTTPKEPAPTTPKGTAPTTLKEPAPTTPKKPAPKELAPTTTKGPTSTTSDKPAPTTPKETAPTTPKEPAPTTPKKPAPTTPETPPPTTSEVSTPTTTKEPTTIHKSPDESTPELSAEPTPKALENSPKEPGVPTTKTPAATKPEMTTTAKDKTTERDLRTTPETTTAAPKMTKETATTTEKTTESKITATTTQVTSTTTQDTTPFKITTLKTTTLAPKVTTTKKTITTTEIMNKPEETAKPKDRATNSKATTPKPQKPTKAPKKPTSTKKPKTMPRVRKPKTTPTPRKMTSTMPELNPTSRIAEAMLQTTTRPNQTPNSKLVEVNPKSEDAGGAEGETPHMLLRPHVFMPEVTPDMDYLPRVPNQGIIINPMLSDETNICNGKPVDGLTTLRNGTLVAFRGHYFWMLSPFSPPSPARRITEVWGIPSPIDTVFTRCNCEGKTFFFKDSQYWRFTNDIKDAGYPKPIFKGFGGLTGQIVAALSTAKYKNWPESVYFFKRGGSIQQYIYKQEPVQKCPGRRPALNYPVYGETTQVRRRRFERAIGPSQTHTIRIQYSPARLAYQDKGVLHNEVKVSILWRGLPNVVTSAISLPNIRKPDGYDYYAFSKDQYYNIDVPSRTARAITTRSGQTLSKVWYNCP

SEQ ID NO: 60237 - protein, 277 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 60238 - protein, 242 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 60239 - protein, 277 aa, Homo sapiens; identical to SEQ ID NO: 60237

SEQ ID NO: 60240 - protein, 127 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSR

SEQ ID NO: 60241 - protein, 255 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQKGRGSRGQHQAHSLERVCHCLGKWLGHPDKFVGITYALTVVWLLVFACSAVPVYIYFNTWTTCQSIAFPSKTSASIGSLCADARMYGVLPWNAFPGKVCGSNLLSICKTAEFQMTFHLFIAAFVGAAATLVSLLTFMIAATYNFAVLKLMGRGTKF

SEQ ID NO: 60242 - protein, 137 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLER

SEQ ID NO: 60243 - protein, 100 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQI

SEQ ID NO: 60244 - protein, 123 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKG

SEQ ID NO: 60245 - protein, 112 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKG

SEQ ID NO: 60246 - protein, 136 aa, Homo sapiens
MGLLECCARCLVGAPFASLVATGLCFFGVALFCGCGHEALTGTEKLIETYFSKNYQDYEYLINVIHAFQYVIYGTASFFFLYGALLLAEGFYTTGAVRQIFGDYKTTICGKGLSATVTGGQKGRGSRGQHQAHSLE

SEQ ID NO: 60247 - protein, 145 aa, Homo sapiens
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVKAMGAALKHRAKGLRSQGPFLPLLLAEIV

SEQ ID NO: 60248 - protein, 152 aa, Homo sapiens
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVLGLIATCLFGYDAYVTFPVRQPRHTAAPTDPADGPV

SEQ ID NO: 60249 - protein, 111 aa, Homo sapiens
MSDAAVDTSSEITTKDLKEKKEVVEEAENGRDAPANGNAENEENGEQEADNEVDEEEEEGGEEEEEEEEGDGEEEDGDEDEEAESATGKRAAEDDEDDDVDTKKQKTDEDD

SEQ ID NO: 60250 - protein, 135 aa, Homo sapiens
MQTFGPAGVAAVGRRVESPADRRATRACHCKLCLPAGSLQGLKGEEGSVEEAENGRDAPANGNANEENGEQEADNEVDEEEEEGGEEEEEEEEGDGEEEDGDEDEEAESATGKRAAEDDEDDDVDTKKQKTDEDD

SEQ ID NO: 60251 - protein, 110 aa, Homo sapiens
MSDAAVDTSSEITTKDLKEKKEVVEEAENGRDAPANGNANEENGEQEADNEVDEEEEEGGEEEEEEEEGDGEEEDGDEDEEAESATGKRAAEDDEDDDVDTKKQKTDEDD

SEQ ID NO: 60252 - protein, 1237 aa, Homo sapiens
MDSGAGGRRCPEAALLILGPPRMEHLRHSPGPGGQRLLLPSMLLALLLLLAPSPGHATRVVYKVPEEQPPNTLIGSLAADYGFPDVGHLYKLEVGAPYLRVDGKTGDIFTTETSIDREGLRECQNQLPGDPCILEFEVSITDLVQNGSPRLLEGQIEVQDINDNTPNFASPVITLAIPENTNIGSLFPIPLASDRDAGPNGVASYELQAGPEAQELFGLQVAEDQEEKQPQLIVMGNLDRERWDSYDLTIKVQDGGSPPRASSALLRVTVLDTNDNAPKFERPSYEAELSENSPIGHSVIQVKANDSDQGANAEIEYTFHQAPEVVRRLLRLDRNTGLITVQGPVDREDLSTLRFSVLAKDRGTNPKSARAQVVVTVKDMNDNAPTIEIRGIGLVTHQDGMANISEDVAEETAVALVQVSDRDEGENAAVTCVVAGDVPFQLRQASETGSDSKKKYFLQTTTPLDYEKVKDYTIEIVAVDSGNPPLSSTNSLKVQVVDVNDNAPVFTQSVTEVAFPENNKPGEVIAEITASDADSGSNAELVYSLEPEPAAKGLFTISPETGEIQVKTSLDREQRESYELKVVAADRGSPSLQGTATVLVNVLDCNDNDPKFMLSGYNFSVMENMPALSPVGMVTVIDGDKGENAQVQLSVEQDNGDFVIQNGTGTILSSLSFDREQQSTYTFQLKAVDGGVPPRSAYVGVTINVLDENDNAPYITAPSNTSHKLLTPQTRLGETVSQVAAEDFDSGVNAELIYSIAGGNPYGLFQIGSHSGAITLEKEIERRHHGLHRLVVKVSDRGKPPRYGTALVHLYVNETLANRTLLETLLGHSLDTPLDIDIAGDPEYERSKQRGNILFGVVAGVVAVALLIALAVLVRYCRQREAKSGYQAGKKETKDLYAPKPSGKASKGNKSKGKKSKSPKPVKPVEDEDEAGLQKSLKFNLMSDAPGDSPRIHLPLNYPPGSPDLGRHYRSNSPLPSIQLQPQSPSASKKHQVVQDLPPANTFVGTGDTTSTGSEQYSDYSYRTNPPKYPSKQLPHRRVTFSATSQAQELQDPSQHSYYDSGLEESETPSSKSSSGPRLGPLALPEDHYERTTPDGSIGEMEHPENDLRPLPDVAMTGTCTRECSEFGHSDTCWMPGQSSPSRRTKSSALKLSTFVPYQDRGGQEPAGAGSPSPPEDRNTKTAPVRLLPSYSAFSHSSHDSCKDSATLEEIPLTQTSDFPPAATPASAQTAKREIYL
